(12) United States Patent
Yang et al.

(10) Patent No.: US 10,035,997 B2
(45) Date of Patent: Jul. 31, 2018

(54) G24 GLUCOAMYLASE COMPOSITIONS AND METHODS

(71) Applicant: Fornia BioSolutions, Inc., Hayward, CA (US)

(72) Inventors: Jie Yang, Foster City, CA (US); Goutami Banerjee, Hayward, CA (US); Xiyun Zhang, Fremont, CA (US); Khin Oo, Daly City, CA (US); Yingxin Zhang, Mountain View, CA (US)

(73) Assignee: Fornia BioSolutions, Inc., Hayward, CA (US)

( * ) Notice: Subject to any disclaimer, the term of this patent is extended or adjusted under 35 U.S.C. 154(b) by 0 days.

(21) Appl. No.: 15/216,592

(22) Filed: Jul. 21, 2016

(65) Prior Publication Data

US 2018/0023066 A1 Jan. 25, 2018

(51) Int. Cl.
| | |
|---|---|
| *C12P 19/14* | (2006.01) |
| *C12N 9/34* | (2006.01) |
| *C12P 19/02* | (2006.01) |
| *A23K 20/189* | (2016.01) |

(52) U.S. Cl.
CPC .......... *C12N 9/2428* (2013.01); *A23K 20/189* (2016.05); *C12P 19/02* (2013.01); *C12P 19/14* (2013.01); *C12Y 302/01003* (2013.01)

(58) Field of Classification Search
None
See application file for complete search history.

(56) References Cited

U.S. PATENT DOCUMENTS

2015/0197760 A1* 7/2015 Los ................. C12N 9/2408
435/471

OTHER PUBLICATIONS

International Search Report dated Mar. 17, 2017 in Application No. PCT/US2016/043403, 16 pages.
European Search Report dated Mar. 17, 2017 in Application No. 16181741.6, 11 pages.

* cited by examiner

*Primary Examiner* — Hope Robinson
(74) *Attorney, Agent, or Firm* — Morgan, Lewis & Bockius LLP

(57) ABSTRACT

The invention is directed to variant glucoamylases as compared to SEQ ID NO:1, including amino acid substitutions at positions including 24, 32, 47, 71, 75, 88, 102, 104, 114, 118, 190, 201, 204, 260, 228, 230, 269, 271, 272, 281, 283, 284, 285, 293, 350, 313, 321, 338, 343, 367, 371, 386, 372, 401, 408, 420, 448, 463, 483, 484, 507, 530, 563 599 and 605 that retain glucoamylase activity.

20 Claims, 16 Drawing Sheets

FIG. 3A

| Colony Tracking Number | Activity Improvement PF* at pH4.5, 40°C, 24hrs | Activity/ General Stability Improvement PF* at pH4.5, 40°C, 48hrs | Thermostability Improvement PF at pH4.5, 40°C, 48hrs after preincubation at 52°C for 10mins | AA Mutation w.r.t. G1P (WT) | Amino Acid SEQ ID NO: | Nucleic Acid SEQ ID NO: |
|---|---|---|---|---|---|---|
| CL00002154 | 1.00 | 1.00 | 1.00 | Baseline | 1 | 2 |
| CL00007376 | 0.96 | 1.03 | 1.41 | S24A/E75D/Q228P/L230F/C271W/P281S/ A283G/L284F/S285V/S293F/T372P | 3 | 4 |
| CL00007391 | 0.70 | 0.69 | 1.28 | E75D/I190V/G463S | 5 | 6 |
| CL00007399 | 0.91 | 0.97 | 1.33 | I47V/A114G/S285A/R371G | 7 | 8 |
| CL00007410 | 1.06 | 1.11 | 1.23 | S24A/A114G | 9 | 10 |
| CL00007417 | 1.34 | 1.48 | 1.15 | I47V/I190V/N599D | 11 | 12 |
| CL00007422 | 0.96 | 0.98 | 1.34 | E75D | 13 | 14 |
| CL00007424 | 1.17 | 1.23 | 1.59 | I47V/E75D/S204A | 15 | 16 |
| CL00007426 | 1.15 | 1.24 | 1.19 | N599D | 17 | 18 |
| CL00007453 | 1.02 | 1.56 | 1.28 | E75D/S285A | 19 | 20 |
| CL00007454 | 0.56 | 1.51 | 0.74 | H401Y/N599D | 21 | 22 |
| CL00007455 | 0.81 | 1.94 | 1.15 | E75D/R371G | 23 | 24 |
| CL00007460 | 0.88 | 0.87 | 1.35 | I47V | 25 | 26 |
| CL00007465 | 1.45 | 1.92 | 0.90 | I47V/I313V | 27 | 28 |
| CL00007466 | 1.23 | 2.09 | 1.11 | S204A | 29 | 30 |
| CL00007470 | 1.39 | 1.31 | 1.07 | A448G | 31 | 32 |
| CL00007473 | 1.08 | 1.35 | 1.08 | I47V/A114G/A530T | 33 | 34 |
| CL00007486 | 0.87 | 0.70 | 1.36 | E75D/S285A/A350S | 35 | 36 |
| CL00007499 | 1.11 | 1.19 | 1.54 | I47V/A114G/S285A/I313V | 37 | 38 |
| CL00007503 | 1.14 | 1.27 | 1.07 | S285A/R371G/N599D | 39 | 40 |
| CL00007505 | 1.21 | 1.19 | 1.18 | S24A/I47V/E75D/S204A/S285A | 41 | 42 |
| CL00007507 | 1.45 | 1.45 | 0.96 | I313V/A530T | 43 | 44 |

FIG. 3B

| Colony Tracking Number | Activity Improvement PF* at pH4.5, 40°C, 24hrs | Activity/ General Stability Improvement PF* at pH4.5, 40°C, 48hrs | Thermostability Improvement PF at pH4.5, 40°C, 48hrs after preincubation at 52°C for 10mins | AA Mutation w.r.t. G1P (WT) | Amino Acid SEQ ID NO: | Nucleic Acid SEQ ID NO: |
|---|---|---|---|---|---|---|
| CL00007512 | 1.52 | 1.64 | 1.17 | I47V/E75D/S204A/A530T | 45 | 46 |
| CL00007525 | 1.03 | 0.97 | 1.26 | I190V/A350S/R371G | 47 | 48 |
| CL00007530 | 0.69 | 0.69 | 1.35 | I47V/R371G | 49 | 50 |
| CL00007540 | 1.27 | 1.26 | 1.15 | S24A/I47V/I190V/S285A/A350S | 51 | 52 |
| CL00007543 | 1.50 | 1.64 | 1.03 | I47V/N599D | 53 | 54 |
| CL00007550 | 1.26 | 1.42 | 1.35 | D102S/A114G/N599D | 55 | 56 |
| CL00007554 | 1.49 | 1.64 | 1.13 | S24A/A114G/N599D | 57 | 58 |
| CL00007561 | 1.36 | 1.44 | 1.13 | A530T | 59 | 60 |
| CL00007563 | 1.15 | 1.20 | 1.14 | I47V/I190V | 61 | 62 |
| CL00007572 | 1.38 | 1.51 | 1.23 | I190V/S285A/A350S/N599D | 63 | 64 |
| CL00007578 | 1.78 | 2.28 | 1.70 | A114G/I190V/S204A/S285A/A350S/R371G/N599D | 65 | 66 |
| CL00007586 | 1.21 | 1.23 | 1.11 | S24A/I47V/S204A/S285A | 67 | 68 |
| CL00007608 | 1.39 | 1.31 | 1.00 | I313V | 69 | 70 |
| CL00007615 | 2.00 | 2.22 | 1.30 | I47V/I190V/S285A/A448G/N599D | 71 | 72 |
| CL00007619 | 1.35 | 1.37 | 1.10 | I47V/I190V/S285A/I313V | 73 | 74 |
| CL00007645 | 1.16 | 1.16 | 1.11 | S24A | 75 | 76 |
| CL00007647 | 0.94 | 1.01 | 1.21 | S24A/I47V/E75D/D272N/N599D | 77 | 78 |
| CL00007650 | 1.21 | 1.30 | 1.24 | A114G/A350S | 79 | 80 |
| CL00007660 | 1.26 | 1.31 | 0.95 | S24A/I47V/A530T | 81 | 82 |
| CL00007669 | 1.92 | 2.14 | 1.73 | I47V/E75D/A114G/I313V/N599D | 83 | 84 |
| CL00007671 | 1.32 | 1.47 | 1.39 | I47V/A114G/S204A/N599D | 85 | 86 |
| CL00007683 | 1.04 | 1.03 | 1.31 | S24A/I190V | 87 | 88 |
| CL00007692 | 1.45 | 1.51 | 1.10 | E75D/I313V/N599D | 89 | 90 |

FIG. 3C

| Colony Tracking Number | Activity Improvement PF* at pH4.5, 40°C, 24hrs | Activity/ General Stability Improvement PF* at pH4.5, 40°C, 48hrs | Thermostability Improvement PF at pH4.5, 40°C, 48hrs after preincubation at 52°C for 10mins | AA Mutation w.r.t. G1P (WT) | Amino Acid SEQ ID NO: | Nucleic Acid SEQ ID NO: |
|---|---|---|---|---|---|---|
| CL00007693 | 0.93 | 0.94 | 1.24 | I47V/I190V/S285A | 91 | 92 |
| CL00007722 | 1.50 | 1.55 | 1.26 | A114G/S204A/A530T | 93 | 94 |
| CL00007732 | 1.24 | 1.25 | 1.24 | I47V/E75D | 95 | 96 |
| CL00007743 | 1.42 | 1.54 | 0.94 | S24A/I47V/R371G/N599D | 97 | 98 |
| CL00007744 | 1.25 | 1.32 | 1.16 | S24A/E75D/S285A | 99 | 100 |
| CL00007745 | 1.59 | 1.81 | 1.26 | I47V/A114G/A260G/A269G/Y321F/A350S/N599D | 101 | 102 |
| CL00007757 | 1.30 | 1.30 | 1.00 | S24A/A350S/R371G/A530T | 103 | 104 |
| CL00007758 | 1.59 | 1.62 | 1.39 | A114G/L338R/Y343S/A367D/A448G | 105 | 106 |
| CL00007759 | 1.70 | 1.84 | 1.46 | S24A/A114G/I190V/S204A | 107 | 108 |
| CL00007771 | 1.17 | 1.21 | 1.18 | A350S | 109 | 110 |
| CL00007772 | 1.32 | 1.40 | 1.12 | A350S/N599D | 111 | 112 |
| CL00007773 | 1.73 | 1.68 | 0.92 | S204A/I313V/A350S/N599D | 113 | 114 |
| CL00007774 | 1.11 | 1.09 | 1.11 | S24A/I47V/D102S/A114G/I190V/S285A/A350S | 115 | 116 |
| CL00007776 | 1.53 | 1.41 | 0.78 | A350S/T483A/P484T | 117 | 118 |
| CL00007781 | 1.42 | 1.44 | 1.05 | S24A/E75D/N599D | 119 | 120 |
| CL00007782 | 1.43 | 1.54 | 1.49 | S24A/I47V/E75D/A114G/I190V/S285A | 121 | 122 |
| CL00007793 | 1.28 | 1.38 | 1.08 | S285A/N599D | 123 | 124 |
| CL00007799 | 0.82 | 0.95 | 1.30 | I47V/E75D/S285A/R371G/N599D | 125 | 126 |
| CL00007802 | 1.34 | 1.44 | 1.09 | S24A/I47V/A114G/S285A | 127 | 128 |
| CL00007806 | 1.19 | 1.30 | 1.21 | I47V/A114G | 129 | 130 |
| CL00007810 | 1.37 | 1.43 | 1.11 | I47V/A350S/N599D | 131 | 132 |
| CL00007813 | 1.18 | 1.24 | 1.05 | R371G/N599D | 133 | 134 |
| CL00007821 | 1.12 | 1.10 | 1.17 | S24A/A114G/S204A/S285A/I313V/A350S | 135 | 136 |

FIG. 3D

| Colony Tracking Number | Activity Improvement PF* at pH4.5, 40°C, 24hrs | Activity/ General Stability Improvement PF* at pH4.5, 40°C, 48hrs | Thermostability Improvement PF at pH4.5, 40°C, 48hrs after preincubation at 52°C for 10mins | AA Mutation w.r.t. G1P (WT) | Amino Acid SEQ ID NO: | Nucleic Acid SEQ ID NO: |
|---|---|---|---|---|---|---|
| CL00007827 | 1.17 | 1.19 | 1.10 | S285A | 137 | 138 |
| CL00007829 | 1.26 | 1.26 | 1.06 | I47V/S204A | 139 | 140 |
| CL00007837 | 1.18 | 1.21 | 1.17 | S24A/A114G/R371G | 141 | 142 |
| CL00007860 | 1.14 | 1.28 | 1.13 | I47V/S204A/S285A/N599D | 143 | 144 |
| CL00007982 | 1.12 | 1.13 | 1.29 | S201Q/K605T | 145 | 146 |
| CL00007993 | 1.22 | 1.24 | 0.76 | T32I/Y118F/S563T | 147 | 148 |
| CL00007996 | 1.11 | 1.16 | 1.45 | L88I/Y118F/A367S/S386A/T420L/S563T | 149 | 150 |
| CL00007997 | 0.96 | 0.94 | 1.32 | T420L | 151 | 152 |
| CL00008004 | 1.02 | 1.15 | 1.13 | Y118F/S563T | 153 | 154 |
| CL00008010 | 1.37 | 1.41 | 0.87 | S563T | 155 | 156 |
| CL00008024 | 1.17 | 1.25 | 1.29 | T420L/S563T/K605T | 157 | 158 |
| CL00008057 | 1.19 | 1.20 | 0.85 | L88I/R104P/K605T | 159 | 160 |
| CL00008077 | 1.20 | 1.29 | 1.06 | R71K | 161 | 162 |
| CL00008094 | 1.19 | 1.19 | 0.92 | Y118F/A367S | 163 | 164 |
| CL00008100 | 1.51 | 1.62 | 0.79 | T32I/R71K/Y118F/S563T/K605T | 165 | 166 |
| CL00008103 | 1.14 | 1.18 | 1.28 | T420L/K605T | 167 | 168 |
| CL00008127 | 1.25 | 1.32 | 1.05 | S563T/K605T | 169 | 170 |
| CL00008139 | 1.35 | 1.47 | 1.13 | Y118F/K605T | 171 | 172 |
| CL00008185 | 1.37 | 1.44 | 1.02 | L88I | 173 | 174 |
| CL00008210 | 1.14 | 1.35 | 0.70 | T32I/K605T | 175 | 176 |
| CL00008233 | 1.39 | 1.62 | 1.18 | S386A/T420L | 177 | 178 |
| CL00008257 | 1.26 | 1.51 | 1.06 | K605T | 179 | 180 |
| CL00008274 | 1.14 | 1.33 | 0.93 | T32I/Y118F/T420L/K605T | 181 | 182 |

*FIG. 3E*

| Colony Tracking Number | Activity Improvement PF* at pH4.5, 40°C, 24hrs | Activity/ General Stability Improvement PF* at pH4.5, 40°C, 48hrs | Thermostability Improvement PF at pH4.5, 40°C, 48hrs after preincubation at 53°C for 10mins | AA Mutation w.r.t. G1P (WT) | Amino Acid SEQ ID NO: | Nucleic Acid SEQ ID NO: |
|---|---|---|---|---|---|---|
| CL00008291 | 1.07 | 1.27 | 0.67 | T32I/R71K | 183 | 184 |
| CL00008296 | 1.21 | 1.18 | 0.65 | T32I/S563T | 185 | 186 |
| CL00008310 | 1.68 | 1.78 | 0.96 | R71K/S563T/K60ST | 187 | 188 |
| CL00008316 | 1.34 | 1.34 | 0.96 | Y118F | 189 | 190 |
| CL00008327 | 1.12 | 1.15 | 1.10 | R104P/S386A/T420L/S563T | 191 | 192 |
| CL00008329 | 1.34 | 1.31 | 0.76 | T32I/R71K/S386A | 193 | 194 |

FIG. 4A

| Colony Tracking Number | Activity Improvement<br>PF at pH4.5, 40°C, 25hrs | Activity/General Stability Improvement<br>PF at pH4.5, 40°C, 72hrs | Thermostability Improvement<br>PF at pH4.5, 40°C, 48hrs after preincubation at 56°C for 10mins | AA Mutation w.r.t. G2P | Amino Acid SEQ ID NO: | Nucleic Acid SEQ ID NO: |
|---|---|---|---|---|---|---|
| CL00007578 | 1.00 | 1.00 | 1.00 | | 65 | 66 |
| CL00015902 | 1.06 | 1.11 | 1.29 | E75D | 195 | 196 |
| CL00015933 | 1.23 | 1.25 | 1.13 | E75D/Y118F/A285S/S563T | 197 | 198 |
| CL00015959 | 1.19 | 1.30 | 1.13 | E75D/Y118F/A285S | 199 | 200 |
| CL00015962 | 1.24 | 1.28 | 1.07 | E75D/A285S/A530T | 201 | 202 |
| CL00015964 | 1.35 | 1.31 | 0.76 | I47V/R71K/I313V/A530T/S563T | 203 | 204 |
| CL00015987 | 1.23 | 1.34 | 0.96 | Y118F/I313V | 205 | 206 |
| CL00015993 | 1.15 | 1.22 | 1.00 | I47V/R71K/Y118F/A367S/S563T | 207 | 208 |
| CL00015999 | 1.30 | 1.31 | 1.12 | E75D/I313V | 209 | 210 |
| CL00016001 | 1.17 | 1.35 | 1.00 | I47V/R71K | 211 | 212 |
| CL00016012 | 1.24 | 1.44 | 1.30 | I47V/E75D/Y118F | 213 | 214 |
| CL00016013 | 1.24 | 1.29 | 1.15 | Y118F/A285S | 215 | 216 |
| CL00016014 | 1.26 | 1.33 | 0.96 | R71K/A367S/A448G | 217 | 218 |
| CL00016023 | 1.38 | 1.36 | 0.99 | A448G/S563T/K605N | 219 | 220 |
| CL00016037 | 1.66 | 1.77 | 1.54 | E75D/Y118F/S507G/A530T/S563T | 221 | 222 |
| CL00016045 | 1.27 | 1.32 | 1.07 | R71K/E75D/S563T | 223 | 224 |
| CL00016046 | 1.29 | 1.37 | 1.21 | I47V/E75D/A530T | 225 | 226 |
| CL00016065 | 1.22 | 1.35 | 1.15 | I47V/E75D/Y118F/A285S | 227 | 228 |
| CL00016070 | 1.15 | 1.28 | 1.38 | E75D/Y118F | 229 | 230 |
| CL00016072 | 1.34 | 1.42 | 1.21 | I47V/E75D | 231 | 232 |
| CL00016083 | 1.06 | 1.08 | 1.30 | E75D/L88I | 233 | 234 |
| CL00016087 | 1.22 | 1.30 | 1.36 | E75D/S563T | 235 | 236 |
| CL00016109 | 1.35 | 1.38 | 1.13 | I47V | 237 | 238 |

FIG. 4B

| Colony Tracking Number | Activity Improvement  PF at pH4.5, 40°C, 39hrs | Activity/ General Stability Improvement  PF at pH4.5, 40°C, 72hrs | Thermostability Improvement  PF at pH4.5, 40°C, 48hrs after preincubation at 56°C for 10mins | AA Mutation w.r.t. G2P | Amino Acid SEQ ID NO: | Nucleic Acid SEQ ID NO: |
|---|---|---|---|---|---|---|
| CL00016119 | 1.17 | 1.25 | 1.21 | E75D/L88I/Y118F/A285S | 239 | 240 |
| CL00016121 | 1.37 | 1.43 | 1.25 | Y118F | 241 | 242 |
| CL00016130 | 1.13 | 1.23 | 1.05 | Y118F/S563T | 243 | 244 |
| CL00016133 | 1.22 | 1.31 | 1.09 | I47V/E75D/A285S | 245 | 246 |
| CL00016147 | 1.24 | 1.38 | 1.09 | R71K/E75D/A367S/S563T | 247 | 248 |
| CL00016154 | 1.18 | 1.21 | 0.81 | I47V/I313V | 249 | 250 |
| CL00016157 | 1.23 | 1.35 | 0.97 | I47V/S563T | 251 | 252 |
| CL00016180 | 1.27 | 1.27 | 1.08 | I47V/R71K/E75D/A367S | 253 | 254 |
| CL00016181 | 1.26 | 1.34 | 0.99 | I47V/I313V/A530T | 255 | 256 |
| CL00016184 | 1.36 | 1.44 | 1.04 | R71K | 257 | 258 |
| CL00016190 | 1.15 | 1.23 | 1.06 | I47V/R71K/E75D | 259 | 260 |
| CL00016192 | 1.19 | 1.35 | 1.03 | I47V/Y118F | 261 | 262 |
| CL00016200 | 1.21 | 1.30 | 0.90 | I47V/R71K/A285S/A367S | 263 | 264 |
| CL00016204 | 1.24 | 1.26 | 1.01 | I47V/R71K/E75D/A285S | 265 | 266 |
| CL00016205 | 1.16 | 1.20 | 1.07 | I47V/E75D/L88I/A285S/I313V/A448G | 267 | 268 |
| CL00016226 | 1.10 | 1.20 | 1.17 | E75D/S386A | 269 | 270 |
| CL00016233 | 1.08 | 1.14 | 1.21 | E75D/L408I | 271 | 272 |
| CL00016238 | 1.20 | 1.32 | 1.41 | E75D/Y118F/A530T | 273 | 274 |
| CL00016265 | 1.30 | 1.27 | 1.04 | R71K/E75D/A285S/S563T | 275 | 276 |
| CL00016277 | 1.22 | 1.26 | 1.04 | A367S/A530T/S563T | 277 | 278 |

*FIG. 5A*

```
G1P:  CL00002154 (SEQ ID NO:1)
G2P:  CL00007578 (SEQ ID NO:65)
G3P:  CL00016037 (SEQ ID NO:221)

SP:  AA 1-20
Catalytic Domain (GH15):      AA 45-455
Starch Binding Domain (CBM20):   AA 541-634
Catalytic Residues:   D205 (Proton acceptor), E208 (Proton donor)
Substrate Binding Residues:  W149

//

1                                                   50
CL00002154    MARGISFALW ALSLGQSAFA APNVSPRAGV GSLDSWLSAE TTYSLNSILT
CL00007578    MARGISFALW ALSLGQSAFA APNVSPRAGV GSLDSWLSAE TTYSLNSILT
CL00016037    MARGISFALW ALSLGQSAFA APNVSPRAGV GSLDSWLSAE TTYSLNSILT 51                                                  100
CL00002154    NTGSNGAYAK SAKPGIIIAS PSLEGPNYYY TWTRDAALTM RVLIEEFRNG
CL00007578    NTGSNGAYAK SAKPGIIIAS PSLEGPNYYY TWTRDAALTM RVLIEEFRNG
CL00016037    NTGSNGAYAK SAKPGIIIAS PSLEGPNYYY TWTRDAALTM RVLIDEFRNG 101                                                  150
CL00002154    KIELQNVLKD YINSQAFLQT VDNRSGGLAS GGLAEPKYNV DMTAFTGDWG

CL00007578    KIELQNVLKD YINSQAFLQT VDNRSGGLAS GGLGEPKYNV DMTAFTGDWG

CL00016037    KIELQNVLKD YINSQAFLQT VDNRSGGLAS GGLGEPKFNV DMTAFTGDWG 151                                                  200
CL00002154    RPQRDGPALR ATAMIDFGNW LIDNGYASYA KDNIWPIVRN DLSYVAQYWP
CL00007578    RPQRDGPALR ATAMIDFGNW LIDNGYASYA KDNIWPIVRN DLSYVAQYWP
CL00016037    RPQRDGPALR ATAMIDFGNW LIDNGYASYA KDNIWPIVRN DLSYVAQYWP 201                                                  250
CL00002154    QSGFDLWEEI NSMSFFTIAA SHRSLVEGSA FAKRVGASCS WCDSQAPQVL
CL00007578    QSGFDLWEEV NSMSFFTIAA SHRALVEGSA FAKRVGASCS WCDSQAPQVL
CL00016037    QSGFDLWEEV NSMSFFTIAA SHRALVEGSA FAKRVGASCS WCDSQAPQVL 251                                                  300
CL00002154    CYQQSFWTGS YMKANTGGGR SGKDANTVLA SIHLFDPEAG CDDATFQPCS
CL00007578    CYQQSFWTGS YMKANTGGGR SGKDANTVLA SIHLFDPEAG CDDATFQPCS
CL00016037    CYQQSFWTGS YMKANTGGGR SGKDANTVLA SIHLFDPEAG CDDATFQPCS 301                                                  350
CL00002154    PRALSNIKVF VDSFRGSLYP VNNGIPQGKA VAIGRYPEDV YYSGNPWFLT
CL00007578    PRALANIKVF VDSFRGSLYP VNNGIPQGKA VAIGRYPEDV YYSGNPWFLT
CL00016037    PRALANIKVF VDSFRGSLYP VNNGIPQGKA VAIGRYPEDV YYSGNPWFLT 351                                                  400
CL00002154    TLAVAEQLYD AIYQWKKSGA ITITSTSLPF FQELYSAAST RTYASSDPAF
```

FIG. 5B

```
             TLAVAEQLYD AIYQWKKSGS ITITSTSLPF FQELYSAAST GTYASSDPAF
CL00007578   TLAVAEQLYD AIYQWKKSGS ITITSTSLPF FQELYSAAST GTYASSDPAF
CL00016037   TLAVAEQLYD AIYQWKKSGS ITITSTSLPF FQELYSAAST GTYASSDPAF 401                                                 450
CL00002154   NAIIDSVKTY ADGYVSIVQS HSANNGSLSE QFDKTYGMST SARDLTWSYA
CL00007578   NAIIDSVKTY ADGYVSIVQS HSANNGSLSE QFDKTYGMST SARDLTWSYA
CL00016037   NAIIDSVKTY ADGYVSIVQS HSANNGSLSE QFDKTYGMST SARDLTWSYA 451                                                 500
CL00002154   ALLTANARRA GVVPPSWAAA QNNQIPGSCS NSGATGTYQP APINSWPVLS
CL00007578   ALLTANARRA GVVPPSWAAA QNNQIPGSCS NSGATGTYQP APINSWPVLS
CL00016037   ALLTANARRA GVVPPSWAAA QNNQIPGSCS NSGATGTYQP APINSWPVLS 501                                                 550
CL00002154   SGTPGTPGTT TTAATVGTST TTTAPTSTTT GPGQCTVPTA VSVTFDELAA
CL00007578   SGTPGTPGTT TTAATVGTST TTTAPTSTTT GPGQCTVPTA VSVTFDELAA
CL00016037   SGTPGTPGTT TTAATVGTST TTTAPTGTTT GPGQCTVPTA VSVTFDELAT 551                                                 600
CL00002154   TAYGETILIV GSIPELGSWD ATKAVALSAT KYSASNPLWF VTIDLPAGKS
CL00007578   TAYGETILIV GSIPELGSWD ATKAVALSAT KYSASNPLWF VTIDLPAGKS
CL00016037   TAYGETILIV GSIPELGSWD ATKAVALSAT KYTASNPLWF VTIDLPAGKS 601                                      642
CL00002154   FEYKYIRKQT NGNVKWESNP NRSYKVPATC NTLTDVKNDT WR
CL00007578   FEYKYIRKQT NGNVKWESDP NRSYKVPATC NTLTDVKNDT WR
CL00016037   FEYKYIRKQT NGNVKWESDP NRSYKVPATC NTLTDVKNDT WR
```

*FIG. 6A*

| Position (mature numbering) | Wild type residue | Particular Variants |
|---|---|---|
| 24 | S | A |
| 32 | T | I |
| 47 | I | V |
| 71 | R | K |
| 75 | E | D |
| 88 | L | I |
| 102 | D | S |
| 104 | R | P |
| 114 | A | G |
| 118 | Y | F |
| 190 | I | V |
| 201 | S | Q |
| 204 | S | A |
| 260 | A | G |
| 228 | Q | P |
| 230 | L | F |
| 269 | A | G |
| 271 | C | W |
| 272 | D | N |
| 281 | P | S |
| 283 | A | G |
| 284 | L | F |
| 285 | S | A, V |
| 293 | S | F |
| 350 | A | S |
| 313 | I | V |
| 321 | Y | F |
| 338 | L | R |
| 343 | Y | S |
| 367 | A | D, S |
| 371 | R | G |
| 386 | S | A |
| 372 | T | P |
| 401 | H | Y |
| 408 | L | I |
| 420 | T | L |
| 448 | A | G |
| 463 | G | S |
| 483 | T | A |
| 484 | P | T |

FIG. 6B

| Position (mature numbering) | Wild type residue | Particular Variants |
|---|---|---|
| 507 | S | G |
| 530 | A | T |
| 563 | S | T |
| 599 | N | D |
| 605 | K | T, N |

FIG. 7A

>CL00002154 G24 AcGlucoamylase G1P (SEQ ID NO:1)
APNVSPRAGVGSLDSWLSAETTYSLNSILTNTGSNGAYAKSAKPGIIIASPSLEGPNYYYTWTRDAALTMRVLIEEF
RNGKIELQNVLKDYINSQAFLQTVDNRSGGLASGGLAEPKYNVDMTAFTGDWGRPQRDGPALRATAMIDFGNWLIDN
GYASYAKDNIWPIVRNDLSYVAQYWPQSGFDLWEEINSMSFFTIAASHRSLVEGSAFAKRVGASCSWCDSQAPQVLC
YQQSFWTGSYMKANTGGGRSGKDANTVLASIHLFDPEAGCDDATFQPCSPRALSNIKVFVDSFRGSLYPVNNGIPQG
KAVAIGRYPEDVYYSGNPWFLTTLAVAEQLYDAIYQWKKSGAITITSTSLPFFQELYSAASTRTYASSDPAFNAIID
SVKTYADGYVSIVQSHSANNGSLSEQFDKTYGMSTSARDLTWSYAALLTANARRAGVVPPSWAAAQNNQIPGSCSNS
GATGTYQPAPINSWPVLSSGTPGTPGTTTTAATVGTSTTTTAPTSTTTGPGQCTVPTAVSVTFDELAATAYGETILI
VGSIPELGSWDATKAVALSATKYSASNPLWFVTIDLPAGKSFEYKYIRKQTNGNVKWESNPNRSYKVPATCNTLTDV
KNDTWR >CL00002154 G24 AcGlucoamylase G1P (SEQ ID NO:2)
GCCCCCAATGTCTCTCCTCGCGCCGGAGTTGGTTCTCTGGACTCTTGGTTGTCCGCTGAGACCACCTACTCTCTCAA
CAGCATTCTCACCAACACCGGATCCAACGGTGCCTATGCGAAGAGCGCGAAGCCTGGTATCATCATTGCCAGTCCCA
GTCTGGAGGGTCCTAATTACTACTACACCTGGACTCGCGATGCCGCTCTGACCATGAGAGTGTTGATCGAGGAGTTC
CGCAACGGAAAAATCGAGCTTCAGAATGTGCTGAAGGACTATATAAACTCGCAGGCTTTCCTCCAGACCGTGGACAA
CCGCTCTGGTGGTCTCGCCAGCGGTGGTCTGGCCGAGCCCAAGTACAATGTGGACATGACCGCCTTCACTGGTGACT
GGGGTCGTCCTCAGCGTGATGGCCCAGCTCTGCGTGCCACCGCCATGATTGACTTCGGCAACTGGCTGATTGACAAT
GGCTATGCCAGCTACGCCAAGGACAACATCTGGCCCATCGTCCGCAACGATCTGTCGTATGTGGCCCAGTACTGGCC
CCAGAGCGGCTTTGACCTCTGGGAAGAAATCAACAGCATGTCCTTTTTCACGATCGCTGCCTCGCACCGTTCCCTCG
TCGAGGGAAGCGCCTTTGCCAAGCGCGTTGGCGCCTCGTGCTCCTGGTGTGACTCCCAGGCCCCCCAGGTTCTCTGC
TACCAGCAGAGCTTCTGGACCGGCTCCTACATGAAGGCCAACACTGGCGGTGGCCGCTCCGGCAAGGACGCCAACAC
CGTCCTGGCCAGTATCCACCTGTTCGACCCCGAGGCTGGCTGCGACGATGCCACCTTCCAGCCCTGCTCTCCCCGCG
CTCTCTCCAACATCAAGGTCTTTGTCGATTCTTTCCGCGGCAGTCTCTACCCCGTCAACAACGGTATTCCCCAGGGC
AAGGCCGTTGCCATTGGCCGTTACCCCGAGGATGTCTACTACAGCGGAAACCCCTGGTTCCTGACCACCCTGGCCGT
CGCCGAGCAGCTGTATGACGCCATCTACCAGTGGAAGAAGAGCGGCGCCATCACCATCACCAGTACTTCGCTGCCTT
TCTTCCAGGAACTGTACAGCGCTGCTTCCACCCGCACCTATGCCTCCTCGGACCCGGCCTTCAACGCGATCATCGAC
TCGGTCAAGACTTACGCCGACGGCTACGTCAGCATTGTGCAATCCCACTCCGCCAACAACGGCTCCCTCTCCGAGCA
GTTCGACAAGACCTACGGCATGTCCACCTCCGCCCGCGACCTGACCTGGTCGTACGCCGCTCTCCTGACTGCCAACG
CCCGCCGCGCCGGTGTCGTCCCCCCGTCCTGGGCCGCAGCCCAGAACAACCAGATCCCCGGCTCGTGCTCCAACAGC
GGCGCCACCGGCACCTACCAGCCCGCCCCGATTAACAGCTGGCCCGTCCTGAGCAGCGGCACCCCCGGCACCCCCGG
CACCACCACCACCGCCGCGACTGTTGGCACCTCCACCACCACCACCGCGCCCACCAGCACCACCACCGGCCCCGGCC
AGTGCACCGTCCCCACCGCCGTGTCCGTGACCTTCGACGAGCTCGCGGCCACCGCCTACGGCGAGACCATTCTCATC
GTCGGCTCCATCCCGGAGCTGGGCAGCTGGGACGCCACCAAGGCCGTCGCCCTCAGCGCCACCAAATACAGTGCCAG
CAACCCCCTGTGGTTCGTGACCATCGACCTGCCCGCCGGCAAGAGCTTCGAGTACAAGTACATCCGCAAGCAGACCA
ACGGCAACGTCAAGTGGGAGAGCAACCCCAACCGCTCCTACAAGGTGCCTGCCACCTGCAACACCTTGACTGACGTC
AAGAACGATACCTGGCGG >CL00007578 G24 AcGlucoamylase G2P (SEQ ID NO:65)
APNVSPRAGVGSLDSWLSAETTYSLNSILTNTGSNGAYAKSAKPGIIIASPSLEGPNYYYTWTRDAALTMRVLIEEF
RNGKIELQNVLKDYINSQAFLQTVDNRSGGLASGGLGEPKYNVDMTAFTGDWGRPQRDGPALRATAMIDFGNWLIDN
GYASYAKDNIWPIVRNDLSYVAQYWPQSGFDLWEEINSMSFFTIAASHRALVEGSAFAKRVGASCSWCDSQAPQVLC
YQQSFWTGSYMKANTGGGRSGKDANTVLASIHLFDPEAGCDDATFQPCSPRALANIKVFVDSFRGSLYPVNNGIPQG
KAVAIGRYPEDVYYSGNPWFLTTLAVAEQLYDAIYQWKKSGSITITSTSLPFFQELYSAASTGTYASSDPAFNAIID
SVKTYADGYVSIVQSHSANNGSLSEQFDKTYGMSTSARDLTWSYAALLTANARRAGVVPPSWAAAQNNQIPGSCSNS
GATGTYQPAPINSWPVLSSGTPGTPGTTTTAATVGTSTTTTAPTSTTTGPGQCTVPTAVSVTFDELAATAYGETILI
VGSIPELGSWDATKAVALSATKYSASNPLWFVTIDLPAGKSFEYKYIRKQTNGNVKWESDPNRSYKVPATCNTLTDV
KNDTWR

FIG. 7B

>CL00007578 G24 AcGlucoamylase G2P (SEQ ID NO:66)
GCCCCCAATGTCTCTCCTCGCGCCGGAGTTGGTTCTCTGGACTCTTGGTTGTCCGCTGAGACCACCTACTCTCTCAA
CAGCATTCTCACCAACACCGGATCCAACGGTGCCTATGCGAAGAGCGCGAAGCCTGGTATCATCATTGCCAGTCCCA
GTCTGGAGGGTCCTAATTACTACTACACCTGGACTCGCGATGCCGCTCTGACCATGAGAGTGTTGATCGAGGAGTTC
CGCAACGGAAAAATCGAGCTTCAGAATGTGCTGAAGGACTATATAAACTCGCAGGCTTTCCTCCAGACCGTGGACAA
CCGCTCTGGTGGTCTCGCCAGCGGTGGTCTGGGCGAGCCCAAGTACAATGTGGACATGACCGCCTTCACTGGTGACT
GGGGTCGTCCTCAGCGTGATGGCCCAGCTCTGCGTGCCACCGCCATGATTGACTTCGGCAACTGGCTGATTGACAAT
GGCTATGCCAGCTACGCCAAGGACAACATCTGGCCCATCGTCCGCAACGATCTGTCGTATGTGGCCCAGTACTGGCC
CCAGAGCGGCTTTGACCTCTGGGAAGAAGTCAACAGCATGTCCTTTTTCACGATCGCTGCCTCGCACCGTGCCCTCG
TCGAGGGAAGCGCCTTTGCCAAGCGCGTTGGCGCCTCGTGCTCCTGGTGTGACTCCCAGGCCCCCCAGGTTCTCTGC
TACCAGCAGAGCTTCTGGACCGGCTCCTACATGAAGGCCAACACTGGCGGTGGCCGCTCCGGCAAGGACGCCAACAC
CGTCCTGGCCAGTATCCACCTGTTCGACCCCGAGGCTGGCTGCGACGATGCCACCTTCCAGCCCTGCTCTCCCCGCG
CTCTCGCCAACATCAAGGTCTTTGTCGATTCTTTCCGCGGCAGTCTCTACCCCGTCAACAACGGTATTCCCCAGGGC
AAGGCCGTTGCCATTGGCCGTTACCCGAGGATGTCTACTACAGCGGAAACCCCTGGTTCCTGACCACCCTGGCCGT
CGCCGAGCAGCTGTATGACGCCATCTACCAGTGGAAGAAGAGCGGCTCCATCACCATCACCAGTCTTCGCTGCCTT
TCTTCCAGGAACTGTACAGCGCTGCTTCCACCGGCACCTATGCCTCCTCGGACCCGGCCTTCAACGCGATCATCGAC
TCGGTCAAGACTTACGCCGACGGCTACGTCAGCATTGTGCAATCCCACTCCGCCAACAACGGCTCCCTCTCCGAGCA
GTTCGACAAGACCTACGGCATGTCCACCTCCGCCCGCGACCTGACCTGGTCGTACGCCGCTCTCCTGACTGCCAACG
CCCGCCGCCGGTGTCGTCCCCCCGTCCTGGGCCGCAGCCCAGAACAACCAGATCCCCGGCTCGTGCTCCAACAGC
GGCGCCACCGGCACCTACCAGCCCGCCCCGATTAACAGCTGGCCCGTCCTGAGCAGCGGCACCCCCGGCACCCCCGG
CACCACCACCACCGCCGCGACTGTTGGCACCTCCACCACCACCACCGCGCCCACCAGCACCACCACCGGCCCCGGCC
AGTGCACCGTCCCCACCGCCGTGTCCGTGACCTTCGACGAGCTCGCGGCCACCGCCTACGGCGAGACCATTCTCATC
GTCGGCTCCATCCCGGAGCTGGGCAGCTGGGACGCCACCAAGGCCGTCGCCCTCAGCGCCACCAAATACAGTGCCAG
CAACCCCCTGTGGTTCGTGACCATCGACCTGCCCGCCGGCAAGAGCTTCGAGTACAAGTACATCCGCAAGCAGACCA
ACGGCAACGTCAAGTGGGAGAGCGATCCCAACCGCTCCTACAAGGTGCCTGCCACCTGCAACACCTTGACTGACGTC
AAGAACGATACCTGGCGG >CL00016037 G24 AcGlucoamylase G3P (SEQ ID NO:221)
APNVSPRAGVGSLDSWLSAETTYSLNSILTNTGSNGAYAKSAKPGIIIASPSLEGPNYYYTWTRDAALTMRVLIDEF
RNGKIELQNVLKDYINSQAFLQTVDNRSGGLASGGLGEPKFNVDMTAFTGDWGRPQRDGPALRATAMIDFGNWLIDN
GYASYAKDNIWPIVRNDLSYVAQYWPQSGFDLWEEVNSMSFFTIAASHRALVEGSAFAKRVGASCSWCDSQAPQVLC
YQQSFWTGSYMKANTGGGRSGKDANTVLASIHLFDPEAGCDDATFQPCSPRALANIKVFVDSFRGSLYPVNNGIPQG
KAVAIGRYPEDVYYSGNPWFLTTLAVAEQLYDAIYQWKKSGSITITSTSLPFFQELYSAASTGTYASSDPAFNAIID
SVKTYADGYVSIVQSHSANNGSLSEQFDKTYGMSTSARDLTWSYAALLTANARRAGVVPPSWAAAQNNQIPGSCSNS
GATGTYQPAPINSWPVLSSGTPGTPGTTTTAATVGTSTTTTAPTGTTTGPGQCTVPTAVSVTFDELATTAYGETILI
VGSIPELGSWDATKAVALSATKYTASNPLWFVTIDLPAGKSFEYKYIRKQTNGNVKWESDPNRSYKVPATCNTLTDV
KNDTWR

FIG. 7C

```
>CL00016037 G24 AcGlucoamylase G3P (SEQ ID NO:222)
GCCCCCAATGTCTCTCCTCGCGCCGGAGTTGGTTCTCTGGACTCTTGGTTGTCCGCTGAGACCACCTACTCTCTCAA
CAGCATTCTCACCAACACCGGATCCAACGGTGCCTATGCGAAGAGCGCGAAGCCTGGTATCATCATTGCCAGTCCCA
GTCTGGAGGGTCCTAATTACTACTACACCTGGACTCGCGATGCCGCTCTGACCATGAGAGTGTTGATCGATGAGTTC
CGCAACGGAAAAATCGAGCTTCAGAATGTGCTGAAGGACTATATAAACTCGCAGGCTTTCCTCCAGACCGTGGACAA
CCGCTCTGGTGGTCTCGCCAGCGGTGGTCTGGGCGAGCCCAAGTTCAATGTGGACATGACCGCCTTCACTGGTGACT
GGGGTCGTCCTCAGCGTGATGGCCCAGCTCTGCGTGCCACCGCCATGATTGACTTCGGCAACTGGCTGATTGACAAT
GGCTATGCCAGCTACGCCAAGGACAACATCTGGCCCATCGTCCGCAACGATCTGTCGTATGTGGCCCAGTACTGGCC
CCAGAGCGGCTTTGACCTCTGGGAAGAAGTCAACAGCATGTCCTTTTTCACGATCGCTGCCTCGCACCGTGCCCTCG
TCGAGGGAAGCGCCTTTGCCAAGCGCGTTGGCGCCTCGTGCTCCTGGTGTGACTCCCAGGCCCCCAGGTTCTCTGC
TACCAGCAGAGCTTCTGGACCGGCTCCTACATGAAGGCCAACACTGGCGGTGGCCGCTCCGGCAAGGACGCCAACAC
CGTCCTGGCCAGTATCCACCTGTTCGACCCCGAGGCTGGCTGCGACGATGCCACCTTCCAGCCCTGCTCTCCCCGCG
CTCTCGCCAACATCAAGGTCTTTGTCGATTCTTTCCGCGGCAGTCTCTACCCCGTCAACAACGGTATTCCCCAGGGC
AAGGCCGTTGCCATTGGCCGTTACCCCGAGGATGTCTACTACAGCGGAAACCCCTGGTTCCTGACCACCCTGGCCGT
CGCCGAGCAGCTGTATGACGCCATCTACCAGTGGAAGAAGAGCGGCTCCATCACCATCACCAGTACTTCGCTGCCTT
TCTTCCAGGAACTGTACAGCGCTGCTTCCACCGGCACCTATGCCTCCTCGGACCCGGCCTTCAACGCGATCATCGAC
TCGGTCAAGACTTACGCCGACGGCTACGTCAGCATTGTGCAATCCCACTCCGCCAACAACGGCTCCCTCTCCGAGCA
GTTCGACAAGACCTACGGCATGTCCACCTCCGCCCGCGACCTGACCTGGTCGTACGCCGCTCTCCTGACTGCCAACG
CCCGCCGCGCCGGTGTCGTCCCCCCGTCCTGGGCCGCAGCCCAGAACAACCAGATCCCCGGCTCGTGCTCCAACAGC
GGCGCCACCGGCACCTACCAGCCCGGCCCCGATTAACAGCTGGCCCGTCCTGAGCAGCGGCACCCCGGCACCCCCGG
CACCACCACCACCGCCGCGACTGTTGGCACCTCCACCACCACCACCGCGCCCACCGGCACCACCACCGGCCCCGGCC
AGTGCACCGTCCCCACCGCCGTGTCCGTGACCTTCGACGAGCTCGCGACCACCGCCTACGGCGAGACCATTCTCATC
GTCGGCTCCATCCCGGAGCTGGGCAGCTGGGACGCCACCAAGGCCGTCGCCCTCAGCGCCACCAAATACACCGCCAG
CAACCCCCTGTGGTTCGTGACCATCGACCTGCCCGCCGGCAAGAGCTTCGAGTACAAGTACATCCGCAAGCAGACCA
ACGGCAACGTCAAGTGGGAGAGCGATCCCAACCGCTCCTACAAGGTGCCTGCCACCTGCAACACCTTGACTGACGTC
AAGAACGATACCTGGCGG
```

G24 GLUCOAMYLASE COMPOSITIONS AND METHODS

SEQUENCE LISTING

The instant application contains a Sequence Listing which has been submitted electronically in ASCII format and is hereby incorporated by reference in its entirety. Said ASCII copy, created on Jul. 20, 2016, is named 114095-5003-US_ST25.txt and is 1,104 kilobytes in size.

FIELD OF THE INVENTION

This invention relates to variant glucoamylases, polynucleotides encoding the variant glucoamylases, methods of producing the variant glucoamylases, and methods of using the variant glucoamylases. Also described are the use of glucoamylases of the invention for varying from starch conversion to produce fermentation products, such as ethanol, and syrups, such as glucose, as well as animal feedstocks. The invention also relates to compositions comprising one or more variant glucoamylases of the invention.

BACKGROUND OF THE INVENTION

Glucoamylase (1,4-alpha-D-glucan glucohydrolase, EC 3.2.1.3) is an enzyme, which catalyzes the release of D-glucose from the non-reducing ends of starch or related oligosaccharide and polysaccharide molecules. Glucoamylases are produced by several filamentous fungi and yeast, with those from Aspergillus being generally most important for commercial purposes.

Commercially, glucoamylases are used to convert starch containing material, which is already partially hydrolyzed by an alpha-amylase, to glucose. The glucose may then be converted directly or indirectly into a fermentation product using a fermenting organism. Examples of commercial fermentation products include alcohols (e.g., ethanol, methanol, butanol, 1,3-propanediol); organic acids (e.g., citric acid, acetic acid, itaconic acid, lactic acid, gluconic acid, gluconate, lactic acid, succinic acid, 2,5-diketo-D-gluconic acid); ketones (e.g., acetone); amino acids (e.g., glutamic acid); gases (e.g., $H_2$ and $CO_2$), and more complex compounds, including, for example, antibiotics (e.g., penicillin and tetracycline); enzymes; vitamins (e.g., riboflavin, $B_{12}$, beta-carotene); hormones, and other compounds which are difficult to produce synthetically. Fermentation processes are also commonly used in the consumable alcohol (e.g., beer and wine), dairy (e.g., in the production of yogurt and cheese) industries.

The end product may also be syrup. For instance, the end product may be glucose, but may also be converted, e.g., by glucose isomerase to fructose or a mixture composed almost equally of glucose and fructose. This mixture, or a mixture further enriched with fructose, is the most commonly used high fructose corn syrup (HFCS) commercialized throughout the world.

The end product may also be a commercial feedstock, fed to agricultural animals. Furthermore, glucoamylase has significant applications in food, textile and pharmaceutical industries. In the food industry for an example, glucoamylase is used to improve bread crust color and produce low-calorie beer. Another key application of glucoamylase is as a digestive aid when used together with a cocktail of other enzymes.

However, there remains a need in the art for variant glucoamylases with increased activity, thermoactivity, thermostability and pH stability. The present invention meets this need and provides variant glucoamylases with improved properties compared to a parent glucoamylase.

It is an object of the present invention to provide variant glucoamylase enzymes having glucoamylase activity and polynucleotides encoding the variant glucoamylase enzymes and methods of using the variant glucoamylase enzymes in various processes.

BRIEF SUMMARY OF THE INVENTION

Accordingly, the present invention provides variant glucoamylases and methods of using them. In one aspect, the invention provides compositions comprising variant glucoamylase enzymes comprising at least one amino acid substitutions as compared to SEQ ID NO:1, wherein said amino acid substitution is at position number selected from the group consisting of: 114, 530, 190, 599, 24, 32, 47, 71, 75, 88, 102, 104, 118, 201, 204, 260, 228, 230, 269, 271, 272, 281, 283, 284, 285, 293, 350, 313, 321, 338, 343, 367, 371, 386, 372, 401, 408, 420, 463, 448, 483, 484, 507, 563 and 605. In some embodiments of this aspect, the variant enzyme is at least 95%, 96%, 97%, 98% or 99% identical to one or more of SEQ ID NO:1, SEQ ID NO:65 or SEQ ID NO:221.

In an additional aspect, the invention provides compositions comprising a variant glucoamylase enzyme comprising at least one amino acid substitutions as compared to SEQ ID NO:1, wherein the amino acid substitution is at position number selected from the group consisting of: 114, 530, 190, 599, 24, 32, 47, 71, 75, 88, 102, 104, 118, 201, 204, 260, 228, 230, 269, 271, 272, 281, 283, 284, 285, 293, 350, 313, 321, 338, 343, 367, 371, 386, 372, 401, 408, 420, 448, 463, 483, 484, 507, 563 and 605, wherein said variant glucoamylase enzyme has at least at least 1.1 fold better activity as compared to SEQ ID NO:1 under a condition selected from the group consisting of activity and thermoactivity at 40° C., thermostability at 52° C., thermostability at 56° C. and pH activity at pH 4.5. In some embodiments of this aspect, the variant enzyme is at least 95%, 96%, 97%, 98% or 99% identical to one or more of SEQ ID NO:1, SEQ ID NO:65 or SEQ ID NO:221.

In a further aspect, the invention provides variant glucoamylase enzymes comprising at least one amino acid substitutions as compared to SEQ ID NO:1, wherein the amino acid substitution is selected from the group consisting of: A114G, A530T, I190V, N599D, S24A, T32I, I47V, R71K, E75D, L88I, D102S, R104P, Y118F, S201Q, S204A, A260G, Q228P, L230F, A269G, C271W, D272N, P281S, A283G, L284F, S285V, S285A, S293F, A350S, I313V, Y321F, L338R, Y343S, A367D, A367S, R371G, S386A, T372P, H401Y, L408I, T420L, A448G, G463S, T483A, P484T, S507G, S563T, K605N, and K605T, wherein said variant glucoamylase enzyme has at least at least 1.1 fold better activity as compared to SEQ ID NO:1 under a condition selected from the group consisting of activity and thermoactivity at 40° C., thermostability at 52° C., thermostability at 56° C. and thermostability at 60° C. In some embodiments of this aspect, the variant enzyme is at least 95%, 96%, 97%, 98% or 99% identical to one or more of SEQ ID NO:1, SEQ ID NO:65 or SEQ ID NO:221.

In an additional aspect, the invention provides compositions of variant glucoamylase enzymes that are at least 90%, 91%, 92%, 93%, 94%, 95%, 96%, 97%, 98%, 99% but less than 100% identity to the parent glucoamylase enzyme of SEQ ID NO:1.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:65.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:221.

In a further aspect, the compositions comprising variant glucoamylase enzymes that have amino acid substitutions at one of the positions, two of the positions, three of the positions, four of the positions, five of the positions, six of the positions, seven of the positions, eight of the positions, nine of the positions, ten of the positions, eleven of the positions, twelve of the positions, thirteen of the positions, fourteen of the positions, fifteen of the positions, sixteen of the positions, seventeen of the positions, eighteen of the positions, nineteen of the positions or twenty of the positions.

In an additional aspect, the invention provides compositions of a variant glucoamylase enzyme that comprises the amino acid substitutions A114G/I190V/S204A/S285A/A350S/R371G/N599D. Additionally, the composition can be at least 95%, 98% or 99% identical to SEQ ID NO:65. In some aspects, the variant glucoamylase has SEQ ID NO:65.

In further aspects, the invention provides compositions of variant glucoamylase enzymes comprising A114G/I190V/S204A/S285A/A350S/R371G/N599D and at least one an amino acid substitution selected from the group consisting of: A530T, S24A, T32I, I47V, R71K, E75D, L88I, D102S, R104P, Y118F, S201Q, A260G, Q228P, L230F, A269G, C271W, D272N, P281S, A283G, L284F, S285V, S293F, I313V, Y321F, L338R, Y343S, A367D, A367S, S386A, T372P, H401Y, L408I, T420L, A448G, G463S, T483A, P484T, S507G, S563T, K605N and K605T.

In an additional aspect, the invention provides compositions of a variant glucoamylase comprising the amino acid substitutions: A114G/I190V/S204A/S285A/A350S/R371G/N599D/E75D/Y118F/S507G/A530T/S563T. In further aspects, the enzyme can be 95, 98 or 99% identical or SEQ ID NO:221. In some aspects, the variant glucoamylase has SEQ ID NO:221.

In a further aspect, the variant enzyme can comprise the amino acid substitutions A114G/I190V/S204A/S285A/A350S/R371G/N599D/E75D/Y118F/S507G/A530T/S563T and at least one additional amino acid substitution selected from the group consisting of: S24A, T32I, I47V, R71K, L88I, D102S, R104P, S201Q, A260G, Q228P, L230F, A269G, C271W, D272N, P281S, A283G, L284F, S285V, S293F, I313V, Y321F, L338R, Y343S, A367D, A367S, S386A, T372P, H401Y, L408I, T420L, A448G, G463S, T483A, P484T, K605N and K605T.

In an additional aspect, the invention provides variant glucoamylase enzymes having amino acid substitutions as compared to SEQ ID NO:1 selected from the group consisting of: A114G/I190V/S204A/S285A/A350S/R371G/N599D, A114G/I190V/S204A/S285A/A350S/R371G/N599D/E75D/Y118F/S507G/A530T/S563T, S24A/E75D/Q228P/L230F/C271W/P281S/A283G/L284F/S285V/S293F/T372P, E75D/I190V/G463S, I47V/A114G/S204A/R371G, S24A/A114G, I47V/I190V/N599D, E75D, I47V/E75D/S204A, N599D, E75D/S285A, H401Y/N599D, E75D/R371G, I47V, I47V/I313V, S204A, A448G, I47V/A114G/A530T, E75D/S285A/A350S, I47V/A114G/S285A/I313V, S285A/R371G/N599D, S24A/I47V/E75D/S204A/S285A, I313V/A530T, I47V/E75D/S204A/A530T, I190V/A350S/R371G, I47V/R371G, S24A/I47V/I190V/S285A/A350S, I47V/N599D, D102S/A114G/N599D, S24A/A114G/N599D, A530T, I47V/I190V, I190V/S285A/A350S/N599D, S24A/I47V/S204A/S285A, I313V, I47V/I190V/S285A/A448G/N599D, I47V/I190V/S285A/I313V, S24A, S24A/I47V/E75D/D272N/N599D, A114G/A350S, S24A/I47V/A530T, I47V/E75D/A114G/I313V/N599D, I47V/A114G/S204A/N599D, S24A/I190V, E75D/I313V/N599D, I47V/I190V/S285A, A114G/S204A/A530T, I47V/E75D, S24A/I47V/R371G/N599D, S24A/E75D/S285A, I47V/A114G/A260G/A269G/Y321F/A350S/N599D, S24A/A350S/R371G/A530T, A114G/L338R/Y343S/A367D/A448G, S24A/A114G/I190V/S204A, A350S, A350S/N599D, S204A/I313V/A350S/N599D, S24A/I47V/D102S/A114G/I190V/S285A/A350S, A350S/T483A/P484T, S24A/E75D/N599D, S24A/I47V/E75D/A114G/I190V/S285A, S285A/N599D, I47V/E75D/S285A/R371G/N599D, S24A/I47V/A114G/S285A, I47V/A114G, I47V/A350S/N599D, R371G/N599D, S24A/A114G/S204A/S285A/I313V/A350S, S285A, I47V/S204A, S24A/A114G/R371G, I47V/S204A/S285A/N599D, S201Q/K605T, T32I/Y118F/S563T, L88I/Y118F/A367S/S386A/T420L/S563T, T420L, Y118F/S563T, S563T, T420L/S563T/K605T, L88I/R104P/K605T, R71K, Y118F/A367S, T32I/R71K/Y118F/S563T/K605T, T420L/K605T, S563T/K605T, Y118F/K605T, L88I, T32I/K605T, S386A/T420L, K605T, T32I/Y118F/T420L/K605T, T32I/R71K, T32I/S563T, R71K/S563T/K605T, Y118F, R104P/S386A/T420L/S563T, T32I/R71K/S386A, A114G/I190V/S204A/S285A/A350S/R371G/N599D/E75D, A114G/I190V/S204A/S285A/A350S/R371G/N599D/E75D/Y118F/A285S/S563T, A114G/I190V/S204A/S285A/A350S/R371G/N599D/E75D/Y118F/A285S, A114G/I190V/S204A/S285A/A350S/R371G/N599D/E285S/A530T, A114G/I190V/S204A/S285A/A350S/R371G/N599D/I47V/R71K/I313V/A530T/S563T, A114G/I190V/S204A/S285A/A350S/R371G/N599D/Y118F/I313V, A114G/I190V/S204A/S285A/A350S/R371G/N599D/I47V/R71K/Y118F/A367S/S563T, A114G/I190V/S204A/S285A/A350S/R371G/N599D/E75D/I313V, A114G/I190V/S204A/S285A/A350S/R371G/N599D/I47V/R71K, A114G/I190V/S204A/S285A/A350S/R371G/N599D/I47V/E75D/Y118F, A114G/I190V/S204A/S285A/A350S/R371G/N599D/Y118F/A285S, A114G/I190V/S204A/S285A/A350S/R371G/N599D/R71K/A367S/A448G, A114G/I190V/S204A/S285A/A350S/R371G/N599D/A448G/S563T/K605N, A114G/I190V/S204A/S285A/A350S/R371G/N599D/R71K/E75D/S563T, A114G/I190V/S204A/S285A/A350S/R371G/N599D/I47V/E75D/A530T, A114G/I190V/S204A/S285A/A350S/R371G/N599D/I47V/E75D/Y118F/A285S, A114G/I190V/S204A/S285A/A350S/R371G/N599D/E75D/Y118F, A114G/I190V/S204A/S285A/A350S/R371G/N599D/I47V/E75D, A114G/I190V/S204A/S285A/A350S/R371G/N599D/E75D/L88I, A114G/I190V/S204A/S285A/A350S/R371G/N599D/E75D/S563T, A114G/I190V/S204A/S285A/A350S/R371G/N599D/I47V, A114G/I190V/S204A/S285A/A350S/R371G/N599D/E75D/L88I/Y118F/A285S, A114G/I190V/S204A/S285A/A350S/R371G/N599D/Y118F, A114G/I190V/S204A/S285A/A350S/R371G/N599D/Y118F/S563T, A114G/I190V/S204A/S285A/A350S/R371G/N599D/I47V/E75D/A285S, A114G/I190V/S204A/S285A/A350S/R371G/N599D/R71K/E75D/A367S/S563T, A114G/I190V/S204A/S285A/A350S/R371G/N599D/I47V/I313V, A114G/I190V/S204A/S285A/A350S/R371G/N599D/I47V/S563T, A114G/I190V/S204A/S285A/A350S/R371G/N599D/I47V/R71K/E75D/A367S, A114G/

I190V/S204A/S285A/A350S/R371G/N599D/I47V/I313V/ A530T, A114G/I190V/S204A/S285A/A350S/R371G/ N599D/R71K, A114G/I190V/S204A/S285A/A350S/ R371G/N599D/I47V/R71K/E75D, A114G/I190V/S204A/ S285A/A350S/R371G/N599D/I47F, A114G/I190V/ S204A/S285A/A350S/R371G/N599D/I47V/R71K/A285S/ A367S, A114G/I190V/S204A/S285A/A350S/R371G/ N599D/I47V/R71K/E75D/A285S, A114G/I190V/S204A/ S285A/A350S/R371G/N599D/I47V/E75D/L88I/A285S/ I313V/A448G, A114G/I190V/S204A/S285A/A350S/ R371G/N599D/E75D/S386A, A114G/I190V/S204A/ S285A/A350S/R371G/N599D/E75D/L408I, A114G/I190V/ S204A/S285A/A350S/R371G/N599D/E75D/Y118F/ A530T, A114G/I190V/S204A/S285A/A350S/R371G/ N599D/R71K/E75D/A285S/S563T, and A114G/I190V/ S204A/S285A/A350S/R371G/N599D/A367S/A530T/ S563T In an additional aspect, the variant glucoamylase enzyme comprises a sequence selected from the group consisting of SEQ ID NOs: 65, 221, 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 223, 225, 227, 229, 231, 233, 235, 237, 239, 241, 243, 245, 247, 249, 251, 253, 255, 257, 259, 261, 263, 265, 267, 269, 271, 273, 275, and 277.

In an additional aspect, the invention provides compositions of variant glucoamylases further comprising animal feed.

In a further aspect, the invention provides nucleic acids encoding the variant glucoamylase enzymes of the invention.

In an additional aspect, the invention provides expression vectors comprising the nucleic acids encoding the variant glucoamylase enzymes of the invention.

In a further aspect, the invention provides host cells comprising the expression vectors or the nucleic acids of the invention.

In an additional aspect, the invention provides methods of making a variant glucoamylase enzyme comprising culturing the host cells of the invention under conditions wherein the variant glucoamylase enzyme is produced, and recovering the enzyme.

In some aspects, the invention relates to glucoamylase variants having improved thermal properties, such as thermostability, heat-stability, steam stability, temperature profile, and/or pelleting stability, with thermostable variant enzymes of particular use in many embodiments.

In additional aspects, the invention relates to glucoamylase variants having improved pelleting stability and/or improved acid-stability.

In further aspects, the invention provides methods of starch processing comprising contacting a starch substrate with a novel variant glucoamylase of the invention under conditions wherein the starch is degraded.

BRIEF DESCRIPTION OF THE DRAWINGS

FIGS. 3A, 3B, 3C, 3D, and 3E provide activity improvement data and thermostability data for various first generation variant glucoamylase enzymes. The values of the table were determined as described in Example 1.

FIGS. 4A and 4B provide activity improvement data and thermostability data for various second generation variant glucoamylase enzymes. The values of the table were determined as described in Example 1.

FIGS. 5A and 5B provide a schematic of the domains of the glucoamylase of SEQ ID NO:1 (G1P), SEQ ID NO:65 (G2P), and SEQ ID NO:221 (G3P). The signal sequence, containing the first 20 amino acids, is double underlined. The catalytic domain is bolded and underlined, with the catalytic residues in large italic font and the substrate binding residues in large bolded font. Note that the number of FIG. 6 is inclusive of the signal peptide, which is not the numbering of the variant positions outlined herein; that is, the variant positions herein count the alanine (A) residue as position 1 of the mature protein. Thus, the catalytic domain is amino acids 45-455 in the figure but amino acids 25 to 435 in the mature protein. Similarly, the D205 and E208 catalytic residues of the figure are D185 and E188 in mature numbering, and the substrate binding residue is W149 in the Figure but W129 in the mature protein.

FIGS. 6A and 6B depict a variant table showing some preferred variants in some embodiments of the invention. As described herein, these may be combined in any combination, and with variant sets as outlined herein.

FIGS. 7A, 7B and 7C depict the amino acid and nucleic acid sequences of G1P, G2P and G3P.

DETAILED DESCRIPTION OF THE INVENTION

I. Introduction

Figure 1:
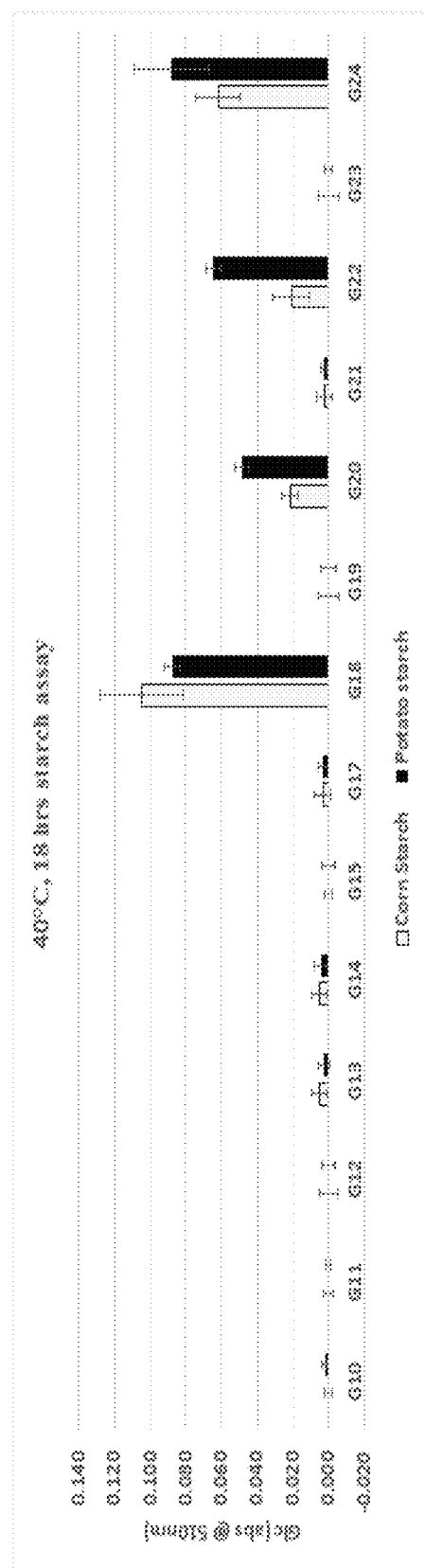
FIG. 1 provides data regarding the activity of various glycoamylases activity on starch substrates. For the assay, 150 µL, of 1% corn starch vs. potato starch (final concentration of 0.75% starch), 25 µL lysate plus 25 µL pH 5.5 buffer was incubated for 18 hours at 40° C. with 650 rpm agitation. 20 µL of the incubated sample was added to 180 µL GOPOD (glucose oxidase/peroxidase) and incubated for 30 minutes at 50° C. with 150 RPM agitation. Absorbance was read at 510 nm to determine glucose released.
Figure 2:
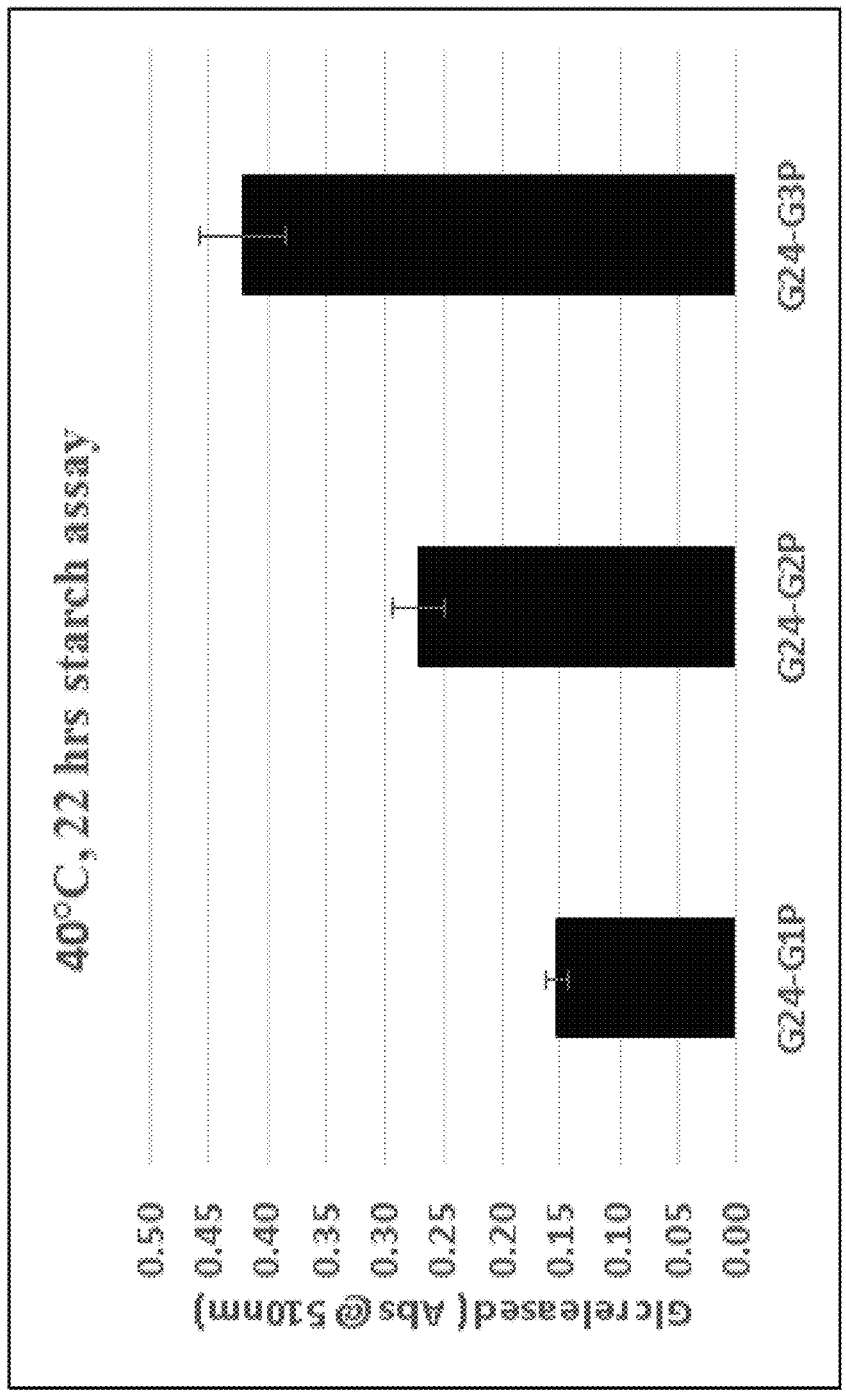
FIG. 2 provides data regarding the activity improvement of G24-G2P and G24-G3P compared to G24-G1P. For the assay, 150 µL, of 2% corn starch vs. potato starch (final concentration of 1.5% starch), 25 µL lysate plus 25 µL pH 5.5 buffer was incubated for 22 hours at 40° C. with 650 rpm agitation. 20 µL of the incubated sample was added to 180 µL GOPOD (glucose oxidase/peroxidase) and incubated for 30 minutes at 50° C. with 150 RPM agitation. Absorbance was read at 510 nm to determine glucose released.

Starch is the major carbohydrate reserve polymer found in a number of important food plant sources, including corn, wheat, potatoes, rice, cassava, oats and others. Starch is used as the substrate for the production of glucose, which in turn is used to make a number of products including liquid fuels (sometimes referred to herein as "biofuels"), proteins, sugars and chemicals, and is used extensively in the food industry. The convention conversion of starch to glucose requires a two step process of liquefaction (converting the solid starchy substrate into a more useable mash) and saccharification (breaking down the mash into simple sugars). Glucoamylase is used in saccharification reactions to release glucose as the final end product, which in turn can be used to produce food, beverages and biofuels. Glucoamylases generally have two domains, a catalytic domain for the actual conversion and a starch binding domain, which allows the phase transfer of a soluble enzyme to the insoluble starch substrate.

However, many of the industrial processes that utilize glucoamylases are run under generally harsh conditions such as high temperature; accordingly, novel thermostable glucoamylases are desired and provided herein.

II. Definitions

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E75D refers to a variant polypeptide, in this case a glucoamylase, in which the glutamic acid at position 75 is replaced with aspartic acid. Multiple mutations are separated by forward slash marks ("/"), e.g., "A114G/I190V/S204A" representing substitutions at positions 114, 190 and 204, respectively. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233#, E233( ) or E233del designates a deletion of glutamic acid at position 233. Additionally, EDA233– or EDA233# designates a deletion of the sequence GluAspAla that begins at position 233.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. In the present case, some embodiments utilize G1P, G2P or G3P as parent polypeptides, with the former being preferred.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide is a wild type sequence, designated "G1P" herein. As further discussed below, the protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Thus, by "variant glucoamylase" herein is meant a novel glucoamylase that has at least one amino acid modification in the amino acid sequence as compared to a parent glucoamylase enzyme. As discussed herein, in some cases the parent glucoamylase is a second or higher generation of variant; that is, as shown in FIG. 3, the G2P glucoamylase has 7 amino acid substitutions as compared to the wild type G1P parent. However, as shown in FIG. 4, the G3P has 5 amino acid substitutions as compared to the G2P parent, but a total of 12 amino acid substitutions as compared to the G1P. Unless otherwise noted or as will be obvious from the context, the variant glucoamylases of the invention generally are compared to the wild type G1P sequence. Additionally, unless otherwise noted, the variant glucoamylases of the invention are enzymatically active, that is, there is detectable glucoamylase activity using the glucoamylase assay described in Example 1 and below, using an assay without temperature treatment.

As used herein, "protein" herein is meant at least two covalently attached amino acids, which includes proteins, polypeptides, oligopeptides and peptides. The peptidyl group generally comprise naturally occurring amino acids and peptide bonds. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Glutamic Acid 75 (also referred to as Glu75 or E75) is a residue at position 75 in the G1P parental enzyme.

By "non-naturally occurring modification" as used herein is meant an amino acid modification that is not found in the parent (e.g. G1P) enzyme.

By "amino acid" and "amino acid identity" as used herein is meant one of the 20 naturally occurring amino acids that are coded for by DNA and RNA.

By "position" as used herein is meant a location in the sequence of a protein. In general, the position number (which is more fully discussed below) is relative to the first amino acid of the mature glucoamylase sequence, e.g. excluding the signal peptide.

The term "glucoamylase" (1,4-alpha-D-glucan glucohydrolase, EC 3.2.1.3) is defined as an enzyme, which catalyzes the release of D-glucose from the non-reducing ends of starch or related oligosaccharide and polysaccharide molecules. For purposes of the present invention, glucoamylase activity is determined according to the procedures described in the Examples herein, for example the Starch Assay to determine glucoamylase activity in Example 1.

The term "coding sequence" refers to a polynucleotide, which directly specifies the amino acid sequence of a variant. The boundaries of the coding sequence are generally determined by an open reading frame, which begins with a start codon such as ATG, GTG or TTG and ends with a stop codon such as TAA, TAG, or TGA. The coding sequence may be a genomic DNA, cDNA, synthetic DNA, or a combination thereof.

The term "control sequences" means nucleic acid sequences necessary for expression of a polynucleotide encoding a variant of the present invention. Each control sequence may be native (i.e., from the same gene) or foreign (i.e., from a different gene) to the polynucleotide encoding the variant or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a variant.

The term "expression" includes any step involved in the production of a variant glucoamylase described herein, including, but not limited to, transcription, post-transcriptional modification, translation, post-translational modification, and secretion.

The term "expression vector" refers to a linear or circular DNA molecule that comprises a polynucleotide encoding a variant and is operably linked to control sequences that provide for its expression.

The term "fragment" means a polypeptide having one or more (e.g., several) amino acids absent from the amino and/or carboxyl terminus of a mature polypeptide. A "glucoamylase fragment" herein means a portion of an amino acid sequence depicted herein that maintains maintains glucoamylase activity. As shown in FIG. 5, the parental glucoamylase enzyme of the invention (G1P) comprises a starch binding domain and a catalytic domain. In some applications, particularly for starch processing, both domains are desirable. In other applications, only the catalytic domain is desired. In one aspect, a fragment contains at least 250, at least 300, at least 350, or at least 400 amino acid residues (e.g., amino acids 1-20, 45-455 and 541-634 of SEQ ID NO: 1; see underlining portion of the sequence in FIG. 5), comprising the catalytic domain and having one or more of the substitutions according to the invention. In some embodiments, the fragment is at least 380, at least 390, at least 400, at least 410 or at least 420 amino acid residues. In some embodiments, the fragment is at least 405, at least 406, at least 407, at least 408, at least 409, at least 410, at least 411, at lest 412, at least 413, at least 414, or at least 415 amino acid residues. In some embodiments, the fragment is at least 409, at least 410, at least 411, at least 412, or at least 413 amino acids residues. In some embodiments, the fragment is at least 411 amino acid residues.

The term "host cell" refers to any cell type that is susceptible to transformation, transfection, transduction, or the like with a nucleic acid construct or expression vector comprising a polynucleotide of the present invention, and that allows for expression of the enzyme. The term "host cell" encompasses any progeny of a parent cell that is not identical to the parent cell due to mutations that occur during replication.

The term "improved property" refers to a characteristic associated with a variant glucoamylase enzyme described herein that is improved compared to the parent glucoamylase enzyme. Such improved properties include, but are not limited to, specific activity, reduced glucose inhibition, reduced isomaltose forming activity, increased activity on maltodextrin DE11-14, increased thermostability (e.g., increased stability at higher temperature), and increased pH stability (e.g., increase stability at higher pH). A further improved property is increased EtOH yield when the variant glucoamylase enzymes is applied in saccharification followed by fermentation on a liquefied mash.

The term "isolated" refers to a substance in a form or environment which does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., multiple copies of a gene encoding the substance; use of a stronger promoter than the promoter naturally associated with the gene encoding the substance).

The term "mature polypeptide" means a polypeptide in its final form following translation and any post-translational modifications, such as N-terminal processing, C-terminal truncation, glycosylation, phosphorylation, etc.

The phrase "mature polypeptide coding sequence" refers to a polynucleotide that encodes a mature polypeptide having glucoamylase activity.

The term "nucleic acid construct" refers to a nucleic acid molecule, either single-stranded or double-stranded, which is isolated from a naturally occurring gene or is modified to contain segments of nucleic acids in a manner that would not otherwise exist in nature or which is synthetic, and which comprises one or more control sequences.

The term "operably linked" refers to a configuration in which a control sequence is placed at an appropriate position relative to the coding sequence of a polynucleotide such that the control sequence directs expression of the coding sequence.

The terms "parent" or "parent glucoamylase" refer to a glucoamylase to which an alteration is made to produce the variant glucoamylases of the present invention. The parent may be a naturally occurring (wild-type) polypeptide or a variant or fragment thereof. An exemplary parent polypeptide of the present invention is SEQ ID NO:1.

The relatedness between two amino acid sequences or between two nucleotide sequences is described by the parameter "sequence identity". For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the –nobrief option) is used as the percent identity and is calculated as follows:

$$(\text{Identical Residues} \times 100)/(\text{Length of Alignment} - \text{Total Number of Gaps in Alignment})$$

The term "subsequence" refers to a polynucleotide having one or more (e.g., several) nucleotides absent from the 5'- and/or 3'-end of a mature polypeptide coding sequence; wherein the subsequence encodes a fragment having glucoamylase activity. In one aspect, a subsequence encodes at least the catalytic domain of the variant according to the invention. For example, contains at least 750, at least 800, at least 850, at least 900, at least 950, at least 1000, at least 1050, at least 1100, at least 1150, at least 1200, at least 1250, at least 1300, at least 1350, or at least 1400 nucleotides (e.g., nucleotides coding for the underlined portion of SEQ ID NO:, as shown in FIG. 5).

The term "variant" refers to a polypeptide having glucoamylase activity and which comprises an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position.

The term "wild-type" glucoamylase means a glucoamylase expressed by a naturally occurring microorganism, such as a bacterium, yeast, or filamentous fungus found in nature. In general, the wild-type glucoamylase of most interest herein is G1P, SEQ ID NO:1.

III. Glucoamylases of the Invention

Accordingly, the present invention provides variant glucoamylases with improved activity that can be used in a variety of applications, including saccharification reactions, animal and human nutritional and feed products and the production of biofuels such as bioethanol.

In general, the variant glucoamylases of the invention have modified, improved biochemical properties as compared to the wild type parental G24 glucoamylase, or "G1P" (e.g. "generation 1 parent"), SEQ ID NO:1 herein, as shown in FIG. 7. The biochemical properties of the variant glucoamylases that can be improved herein include, but are not limited to, pH activity, pH stability, thermostability, specific activity, activity and thermoactivity, formulation stability (including liquid, solid and pellets), performance in animals and/or animal feed and protease stability.

The variant glucoamylases of the invention have one or more improved properties as compared to G1P. By "improved" herein is meant a desirable change of at least one biochemical property. "Improved function" can be measured as a percentage increase or decrease of a particular activity, or as a "fold" change, with increases of desirable properties (e.g. pH stability, thermostability) or decreases of undesirable properties (e.g. protease sensitivity). That is, a variant glucoamylase may have a 10% increase in thermostability or a 10% decrease in protease sensitivity, as compared to G1P. Alternatively, a variant glucoamylase may have a 2-fold increase in pH stability or a 3-fold decrease in protease sensitivity. In general, percentage changes are used to describe changes in biochemical activity of less than 100%, and fold-changes are used to describe changes in biochemical activity of greater than 100% (as compared to the parental enzyme, in many cases G1P). In the present invention, percentage changes (usually increases) of biochemical activity of at least about 10%, 20%, 30%, 40%, 50%, 60%, 70%, 80%, 90%, 95%, 98% and 99% can be accomplished. In the present invention, a "fold increase" (or decrease) is measured as compared to the starting or parent enzyme. For example, as shown in the Figures, G2P has a 1.70 fold increase in thermostability improvement as compared to G1P: this is calculated by [(activity of variant)/ (activity of parent)]. In many embodiments, the improvement is at least one and a tenth fold (1.1), one and a half fold (1.5 fold), 2 fold, 3 fold, 4 fold, 5 fold, 6 fold, 7 fold, 8 fold, 9 fold, or 10 fold or higher.

The variant glucoamylases of the invention can have an improvement one or more of a number of biochemical properties, including, but not limited to, pH activity, pH stability, thermostability, specific activity, activity and thermoactivity, formulation stability (including liquid, solid and pellets), performance in animals and/or animal feed and/or protease stability. In general, improvements are measured as compared to the G1P enzyme using a glucoamylase activity assay, as outlined below, under conditions that challenge the variant glucoamylase against the G1P enzyme.

A. Starch Assay to Determine Glucoamylase Activity and Thermoactivity

In some embodiments, a starch assay is employed to determine glucoamylase activity, such as the one described in the Examples section. Specifically, 150 µl of 1% corn starch in 0.1M sodium acetate, pH 4.5 (final starch concentration of 0.75%) is added to 96 deep well plates. 15 µl-25 µl of enzyme from lysate plates is added to the starch reaction plates (see, for example, Example 1). The final volume is optionally adjusted to 200 µl using 0.1M sodium acetate buffer, pH 4.5. The plates are incubated at 40° C., 800 rpm for 24-72 hrs. At 24 and 72 hrs, the plates are centrifuged at 4000 rpm for 5 minutes and 20 µl of reaction supernatant is taken out into 96 well shallow microtiter plates and 180 µl of D-Glucose assay reagent (GOPOD assay kit from Megazyme, Catalogue # K-GLUC) is added to each well. The plates are then incubated at 50° C. for 30 minutes. Following the incubation, the plates are read at 510 nm to monitor glucose released due to breakdown of starch. Activity of a glucoamylase variant is compared to the parent glucoamylase enzyme under the same conditions to determine activity improvement. In some embodiments the parent glucoamylase enzyme is a polypeptide of SEQ ID NO:1.

B. Thermostability

In many embodiments, the variant glucoamylases of the invention have increased thermostability, particularly under the conditions used in starch processing, such as saccharification, as is more fully outlined below. Thermostability is also a consideration in the production of animal and human feeds, for example, which frequently use high temperatures during the pelleting process for periods of time that traditionally inactivate wild type glucoamylases. "Thermostability" in this context means that the variant enzymes are more stable than the parent glucoamylase (e.g. G1P) under the same thermal challenge conditions, that is, the activity of the variant is higher than that of the G1P under identical conditions (generally using the glucoamylase assay as outlined herein and as shown in Example 1).

In additional embodiments, when the enzyme is used in carbohydrate processing such as saccharification, the enzymes are generally more stable in the presence of the starch substrate. Thus, in these embodiments, the reactions are generally measured in days, with the variant glucoamylases showing significant stability at 24 hours, 48 hours and 72 hours at 60° C. in the presence of substrates as outlined below.

Taken together, the variant glucoamylases of the invention can exhibit increased thermostability as compared to SEQ ID NO:1 at 40° C., 45° C., 50° C., 55° C., 58° C., 60° C., 65° C., 66° C., 70° C., 75° C., 80° C. and/or 85° C. for a period of time, generally ranging from about 10 minutes to 72 hours, with 24, 45, 48 and 72 hours finding particular use in the invention.

Accordingly, as shown in the Figures, a number of variant glucoamylases of the invention exhibit increased thermostability.

C. pH Stability

In many embodiments, the variant glucoamylases of the invention have altered pH activity or stability as compared to the parent glucoamylase. "Increased pH stability" in this context means that the variant enzymes are more stable than the parent glucoamylase (e.g. G1P) under the same pH challenge conditions, that is, the activity of the variant is higher than that of the G1P under identical conditions (generally using the glucoamylase assay as outlined herein and as shown in Example 1). For example, starch processing can be done at a variety of pHs, depending on the raw substrates and reaction conditions D. Specific Activity Assays In some embodiments, the variant glucoamylases of the invention have increased specific activity as compared to a parent glucoamylase, particularly G1P. By "specific activity" herein is meant the activity per amount of enzyme, generally determined by dividing the enzymatic activity of a sample (sometimes measured in "glucoamylase units") by the amount of glucoamylase enzyme, generally determined as is known in the art.

E. Protease Susceptibility

In some embodiments, the variant glucoamylases of the invention are less susceptible to protease degradation than the parent enzyme under identical conditions. In some cases, protease degradation during the production of variant glucoamylases in a production host organism by protease enzymes produced by the host organism can be a problem, thus resulting in lower yield of active enzyme. Similarly, depending on the use of the variant enzymes, for example in starch processing, there may be other proteases present in the raw substrates or other enzymes for use in combination that can degrade the glucoamylase during the starch processing.

This is generally determined as is known in the art, for example by allowing proteolytic degradation and then doing N-terminal sequencing on the resulting fragments to determine the cleavage site(s). In some cases, depending on the variant and the host production organism, there may not be significant proteolytic degradation.

As needed, as will be appreciated by those in the art, the specific mutations that can be made will depend on the endogenous proteases that the host organism produces, and also generally occurs in surface exposed loop structures or turns that are therefore accessible to proteases. For example, production of glucoamylases in *A. niger* fungal production organisms can lead to proteolytic degradation; see Wyss et al., Appl. And Environ. Microbiol. February 1999: 359-366, hereby incorporated by reference in its entirety.

IV. Specific Variant Glucoamylases

The present invention provides variant glucoamylase enzymes comprising an amino acid substitution at one or more (e.g., several) positions corresponding to positions 114, 530, 190, 599, 24, 32, 47, 71, 75, 88, 102, 104, 118, 201, 204, 260, 228, 230, 269, 271, 272, 281, 283, 284, 285, 293, 350, 313, 321, 338, 343, 367, 371, 386, 372, 401, 408, 420, 448, 463, 483, 484, 507, 563 and 605 as compared to a parent glucoamylase enzyme. In some embodiments, the parent glucoamylase enzyme is SEQ ID NO:1. In some embodiments, the variant has at least 75%, at least 80%, at least 85%, at least 90%, at least 95%, at least 96%, at least 97%, at least 98%, or at least 99%, but less than 100% sequence identity to the polypeptide of SEQ ID NO: 1. To be clear, the variant glucoamylases of the invention do not have SEQ ID NO:1.

In some embodiments, the variant glucoamylase enzymes comprise one or more (e.g., several) substitutions selected from the group consisting of A114G, A530T, I190V, N599D, S24A, T32I, I47V, R71K, E75D, L88I, D102S, R104P, Y118F, S201Q, S204A, A260G, Q228P, L230F, A269G, C271W, D272N, P281S, A283G, L284F, S285V, S285A, S293F, A350S, I313V, Y321F, L338R, Y343S, A367D, A367S, R371G, S386A, T372P, H401Y, L408I, T420L, A448G, G463S, T483A, P484T, S507G, S563T, K605N, and K605T.

In some embodiments, the variant glucoamylase enzymes comprise one or more variants selected from FIG. 7.

In some embodiments, the variant glucoamylase enzyme is an isolated variant glucoamylase enzyme.

In some embodiments, the variant glucoamylase enzymes exhibits at least 85%, at least 90%, at least 91%, at least 92%, at least 93%, at least 94%, at least 95%, at least 96%, at least 97%, at least 98%, or at least 99%, but less than 100%, sequence identity to the amino acid sequence of the parent glucoamylase.

In some embodiments, the variant glucoamylase enzymes exhibits at least 85%, at least 90%, at least 91%, at least 92%, at least 93%, at least 94%, at least 95%, at least 96%, at least 97%, at least 98%, or at least 99%, but less than 100%, sequence identity to the amino acid sequence of the parent glucoamylase, SEQ ID NO:1.

In some embodiments, the variant glucoamylase enzyme comprises at least one substitution at position selected from the group consisting of 114, 530, 190, 599, 24, 32, 47, 71, 75, 88, 102, 104, 118, 201, 204, 260, 228, 230, 269, 271, 272, 281, 283, 284, 285, 293, 350, 313, 321, 338, 343, 367, 371, 386, 372, 401, 408, 420, 448, 463, 483, 484, 507, 563 and 605. In some cases, the variant enzyme can comprise 1, 2, 3, 4, 5, 6, 7, 8, 9, 10, 11, 12, 13, 14, 15, 16, 17, 18, 19 or 20 amino acid substitutions at these positions.

In some embodiments, the variant glucoamylase enzyme comprises at least one substitution at position selected from the group consisting of A114G, A530T, I190V, N599D, S24A, T32I, I47V, R71K, E75D, L88I, D102S, R104P, Y118F, S201Q, S204A, A260G, Q228P, L230F, A269G, C271W, D272N, P281S, A283G, L284F, S285V, S285A, S293F, A350S, I313V, Y321F, L338R, Y343S, A367D, A367S, R371G, S386A, T372P, H401Y, L408I, T420L, A448G, G463S, T483A, P484T, S507G, S563T, K605N, and K605T. In some cases, the variant enzyme can comprise 1, 2, 3, 4, 5, 6, 7, 8, 9, 10, 11, 12, 13, 14, 15, 16, 17, 18, 19 or 20 amino acid substitutions at these positions.

In some embodiments, the variant glucoamylase enzyme comprises an amino acid substitution at position 24. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 24 is substituted with Alanine (A). In some embodiments, the Serine (S) at position 24 is substituted with Alanine (A). In some embodiments, the variant glucoamylase enzyme comprises or consists of the substitution S24A of SEQ ID NO:1.

In some embodiments, the variant glucoamylase enzyme comprises an amino acid substitution at position 32. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 32 is substituted with Isoleucine (I). In some embodiments, the Threonine (T) at position 32 is substituted with Isoleucine (I). In some embodiments, the variant glucoamylase enzyme comprises or consists of the substitution T32I of SEQ ID NO:1.

In some embodiments, the variant glucoamylase enzyme comprises an amino acid substitution at position 47. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 47 is substituted with Valine (V). In some embodiments, the Isoleucine (I) at position 47 is substituted with Valine (V). In some embodiments, the variant glucoamylase enzyme comprises or consists of the substitution I47V of SEQ ID NO:1.

In some embodiments, the variant glucoamylase enzyme comprises an amino acid substitution at position 71. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 71 is substituted with Lysine (K). In some embodiments, the Arginine (R) at position 71 is substituted with Lysine (K). In some embodiments, the variant glucoamylase enzyme comprises or consists of the substitution R71K of SEQ ID NO:1.

In some embodiments, the variant glucoamylase enzyme comprises an amino acid substitution at position 75. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 75 is substituted with Aspartate (D). In some embodiments, the Glutamate (E) at position 75 is substituted with Aspartate (D). In some embodiments, the variant glucoamylase enzyme comprises or consists of the substitution E75D of SEQ ID NO:1.

In some embodiments, the variant glucoamylase enzyme comprises an amino acid substitution at position 88. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 88 is substituted with Isoleucine (I). In some embodiments, the Leucine (L) at position 88 is substituted with Isoleucine (I). In some embodiments, the variant glucoamylase enzyme comprises or consists of the substitution L88I of SEQ ID NO:1.

In some embodiments, the variant glucoamylase enzyme comprises an amino acid substitution at position corresponding to position 102. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 102 is substituted with Serine (S). In some embodiments, the Aspartic Acid (D) at position 102 is substituted with Serine (S). In some embodiments, the variant glucoamylase enzyme comprises or consists of the substitution D102S of SEQ ID NO:1.

In some embodiments, the variant glucoamylase enzyme comprises an amino acid substitution at position 104. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 104 is substituted with Proline (P). In some embodiments, the Arginine (R) at position 104 is substituted with Proline (P). In some embodiments, the variant glucoamylase enzyme comprises or consists of the substitution R104P of SEQ ID NO:1.

In some embodiments, the variant glucoamylase enzyme comprises an amino acid substitution at position 114. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 114 is substituted with Glycine (G). In some embodiments, the Alanine (A) at position 114 is substituted with Glycine (G). In some embodiments, the variant glucoamylase enzyme comprises or consists of the substitution A114G of SEQ ID NO:1.

In some embodiments, the variant glucoamylase enzyme comprises an amino acid substitution at position 118. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 118 is substituted with Phenylalanine (F). In some embodiments, the Tyrosine (Y) at position 118 is substituted with Phenylalanine (F). In some embodiments, the variant glucoamylase enzyme comprises or consists of the substitution Y118F of SEQ ID NO:1.

In some embodiments, the variant glucoamylase enzyme comprises an amino acid substitution at position 190. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 190 is substituted with Valine (V). In some embodiments, the Isoleucine (I) at position 190 is substituted with Valine (V). In some embodiments, the variant glucoamylase enzyme comprises or consists of the substitution I190V of SEQ ID NO:1.

In some embodiments, the variant glucoamylase enzyme comprises an amino acid substitution at position 201. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 201 is substituted with Glutamine (Q). In some embodiments, the Serine (S) at position 201 is substituted with Glutamine (Q). In some embodiments, the variant glucoamylase enzyme comprises or consists of the substitution S201Q of SEQ ID NO:1.

In some embodiments, the variant glucoamylase enzyme comprises an amino acid substitution at position 204. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 204 is substituted with Alanine (A). In some embodiments, the Serine (S) at position 204 is substituted with Alanine (A). In some embodiments, the variant glucoamylase enzyme comprises or consists of the substitution S204A of SEQ ID NO:1.

In some embodiments, the variant glucoamylase enzyme comprises an amino acid substitution at position 260. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 260 is substituted with Glycine (G). In some embodiments, the Alanine (A) at position 260 is substituted with Glycine (G). In some embodiments, the variant glucoamylase enzyme comprises or consists of the substitution A260G of SEQ ID NO:1.

In some embodiments, the variant glucoamylase enzyme comprises an amino acid substitution at position 228. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 228 is substituted with Proline (P). In some embodiments, the Glutamine (Q) at position 228 is substituted with Proline (P). In some embodiments, the variant glucoamylase enzyme comprises or consists of the substitution Q228P of SEQ ID NO:1.

In some embodiments, the variant glucoamylase enzyme comprises an amino acid substitution at position 230. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 230 is substituted with Phenylalanine (F). In some embodiments, the Leucine (L) at position 230 is substituted with Phenylalaine (F). In some embodiments, the variant glucoamylase enzyme comprises or consists of the substitution L230F of SEQ ID NO:1.

In some embodiments, the variant glucoamylase enzyme comprises an amino acid substitution at position 269. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 269 is substituted with Glycine (G). In some embodiments, the Alanine (A) at position 269 is substituted with Glycine (G). In some embodiments, the variant glucoamylase enzyme comprises or consists of the substitution A269G of SEQ ID NO:1.

In some embodiments, the variant glucoamylase enzyme comprises an amino acid substitution at position 271. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 271 is substituted with Tryptophan (W). In some embodiments, the Cysteine (C) at position 271 is substituted with Tryptophan (W). In some embodiments, the variant glucoamylase enzyme comprises or consists of the substitution C271W of SEQ ID NO:1.

In some embodiments, the variant glucoamylase enzyme comprises an amino acid substitution at position 272. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 272 is substituted with Asparagine (N). In some embodiments, the Aspartic Acid (D) at position 272 is substituted with Asparagine (N). In some embodiments, the variant glucoamylase enzyme comprises or consists of the substitution D272N of SEQ ID NO:1.

In some embodiments, the variant glucoamylase enzyme comprises an amino acid substitution at position 281. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 281 is substituted with Serine (S). In some embodiments, the Proline (P) at position 281 is substituted with Serine (S). In some embodiments, the variant glucoamylase enzyme comprises or consists of the substitution P281S of SEQ ID NO:1.

In some embodiments, the variant glucoamylase enzyme comprises an amino acid substitution at position 283. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 283 is substituted with Glycine (G). In some embodiments, the Alanine (A) at position 283 is substituted with Glycine (G). In some embodiments, the variant glucoamylase enzyme comprises or consists of the substitution A283G of SEQ ID NO:1.

In some embodiments, the variant glucoamylase enzyme comprises an amino acid substitution at position 284. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 284 is substituted with Phenylalanine (F). In some embodiments, the Leucine (L) at position 284 is substituted with Phenylalanine (F). In some embodiments, the variant glucoamylase enzyme comprises or consists of the substitution L284F of SEQ ID NO:1.

In some embodiments, the variant glucoamylase enzyme comprises an amino acid substitution at position 285. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 285 is substituted with Alanine (A). In some embodiments, the Serine (S) at position 285 is substituted with Alanine (A) or Valine (V). In some embodiments, the variant glucoamylase enzyme comprises or consists of the substitution S285A of SEQ ID NO:1. In some embodiments, S285 is not substituted. In some embodiments, the substitution S285A is reverted to unsubstituted S285 (i.e., A285S).

In some embodiments, the variant glucoamylase enzyme comprises an amino acid substitution at position 293. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 293 is substituted with Phenylalanine (F). In some embodiments, the Serine (S) at position 293 is substituted with Phenylalanine (F). In some embodiments, the variant glucoamylase enzyme comprises or consists of the substitution S293F of SEQ ID NO:1.

In some embodiments, the variant glucoamylase enzyme comprises an amino acid substitution at position 313. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 313 is substituted with Valine (V). In some embodiments, the Isoleucine (I) at position 313 is substituted with Valine (V). In some embodiments, the variant glucoamylase enzyme comprises or consists of the substitution I313V of SEQ ID NO:1.

In some embodiments, the variant glucoamylase enzyme comprises an amino acid substitution at position 321. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 321 is substituted with Phenylalanine (F). In some embodiments, the Tyrosine (Y) at position 321 is substituted with Phenylalanine (F). In some embodiments, the variant glucoamylase enzyme comprises or consists of the substitution Y321F of SEQ ID NO:1.

In some embodiments, the variant glucoamylase enzyme comprises an amino acid substitution at position 338. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 338 is substituted with Arginine (R). In some embodiments, the Leucine (L) at position 338 is substituted with Arginine (R). In some embodiments, the variant glucoamylase enzyme comprises or consists of the substitution L338R of SEQ ID NO:1.

In some embodiments, the variant glucoamylase enzyme comprises an amino acid substitution at position 343. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 343 is substituted with Serine (S). In some embodiments, the Tyrosine (Y) at position 343 is substituted with Serine (S). In some embodiments, the variant glucoamylase enzyme comprises or consists of the substitution Y343S of SEQ ID NO:1.

In some embodiments, the variant glucoamylase enzyme comprises an amino acid substitution at position 350. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 350 is substituted with Serine (S). In some embodiments, the Alanine (A) at position 350 is substituted with Serine (S). In some embodiments, the variant glucoamylase enzyme comprises or consists of the substitution A350S of SEQ ID NO:1.

In some embodiments, the variant glucoamylase enzyme comprises an amino acid substitution at position 367. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 367 is substituted with Aspartic acid (D). In some embodiments, the amino acid at position 367 is substituted with Serine (S). In some embodiments, the Alanine (A) at position 367 is substituted with Aspartic acid (D). In some embodiments, the Alanine (A) at position 367 is substituted with Serine (S). In some embodiments, the variant glucoamylase enzyme comprises or consists of the substitution A367D or A367S of SEQ ID NO:1. In some embodiments, the variant glucoamylase enzyme comprises or consists of the substitution A367D of SEQ ID NO:1. In some embodiments, the variant glucoamylase enzyme comprises or consists of the substitution A367S of SEQ ID NO:1.

In some embodiments, the variant glucoamylase enzyme comprises an amino acid substitution at position 371. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 371 is substituted with Glycine (G). In some embodiments, the Arginine (R) at position 371 is substituted with Glycine (G). In some embodiments, the variant glucoamylase enzyme comprises or consists of the substitution R371G of SEQ ID NO:1.

In some embodiments, the variant glucoamylase enzyme comprises an amino acid substitution at position 386. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 386 is substituted with Alanine (A). In some embodiments, the Serine (S) at position 386 is substituted with Alanine (A). In some embodiments, the variant glucoamylase enzyme comprises or consists of the substitution S386A of SEQ ID NO:1.

In some embodiments, the variant glucoamylase enzyme comprises an amino acid substitution at position 372. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 372 is substituted with Proline (P). In some embodiments, the Threonine (T) at position 372 is substituted with Proline (P). In some embodiments, the variant glucoamylase enzyme comprises or consists of the substitution T372P of SEQ ID NO:1.

In some embodiments, the variant glucoamylase enzyme comprises an amino acid substitution at position 401. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 401 is substituted with Tyrosine (Y). In some embodiments, the Histidine (H) at position 401 is substituted with Tyrosine (Y). In some embodiments, the variant glucoamylase enzyme comprises or consists of the substitution H401Y of SEQ ID NO:1.

In some embodiments, the variant glucoamylase enzyme comprises an amino acid substitution at position 408. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 408 is substituted with Isoleucine (I). In some embodiments, the Leucine (L) at position 408 is substituted with Isoleucine (I). In some embodiments, the variant glucoamylase enzyme comprises or consists of the substitution L408I of SEQ ID NO:1.

In some embodiments, the variant glucoamylase enzyme comprises an amino acid substitution at position 420. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 420 is substituted with Leucine (L). In some embodiments, the Threonine (T) at position 420 is substituted with Glycine (G). In some embodiments, the variant glucoamylase enzyme comprises or consists of the substitution T420L of SEQ ID NO:1.

In some embodiments, the variant glucoamylase enzyme comprises an amino acid substitution at position 448. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 448 is substituted with Glycine (G). In some embodiments, the Alanine (A) at position 448 is substituted with Glycine (G). In some embodiments, the variant glucoamylase enzyme comprises or consists of the substitution A448G of SEQ ID NO:1.

In some embodiments, the variant glucoamylase enzyme comprises an amino acid substitution at position 463. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 463 is substituted with Serine (S). In some embodiments, the Glycine (G) at position 463 is substituted with Serine (S). In some embodiments, the variant glucoamylase enzyme comprises or consists of the substitution G463S of SEQ ID NO:1.

In some embodiments, the variant glucoamylase enzyme comprises an amino acid substitution at position 483. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 483 is substituted with Alanine (A). In some embodiments, the Threonine (T) at position 483 is substituted with Alanine (A). In some embodiments, the variant glucoamylase enzyme comprises or consists of the substitution T483A of SEQ ID NO:1.

In some embodiments, the variant glucoamylase enzyme comprises an amino acid substitution at position 484. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 484 is substituted with Threonine (T). In some embodiments, the Proline (P) at position 484 is substituted with Threonine (T). In some embodiments, the variant glucoamylase enzyme comprises or consists of the substitution P484T of SEQ ID NO:1.

In some embodiments, the variant glucoamylase enzyme comprises an amino acid substitution at position 507. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 507 is substituted with Glycine (G). In some embodiments, the Serine (S) at position 507 is substituted with Glycine (G). In some embodiments, the variant glucoamylase enzyme comprises or consists of the substitution S507G of SEQ ID NO:1.

In some embodiments, the variant glucoamylase enzyme comprises an amino acid substitution at position 530. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 530 is substituted with Threonine (T). In some embodiments, the Alanine (A) at position 530 is substituted with Threonine (T). In some embodiments, the variant glucoamylase enzyme comprises or consists of the substitution A530T of SEQ ID NO:1.

In some embodiments, the variant glucoamylase enzyme comprises an amino acid substitution at position 563. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 563 is substituted with Threonine (T). In some embodiments, the Serine (S) at position 563 is substituted with Threonine (T). In some embodiments, the variant glucoamylase enzyme comprises or consists of the substitution S563T of SEQ ID NO:1.

In some embodiments, the variant glucoamylase enzyme comprises an amino acid substitution at position 599. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 599 is substituted with Aspartic acid (D). In some embodiments, the Asparagine (N) at position 599 is substituted with Aspartic acid (D). In some embodiments, the variant glucoamylase enzyme comprises or consists of the substitution N599D of SEQ ID NO:1.

In some embodiments, the variant glucoamylase enzyme comprises an amino acid substitution at position 605. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid at position 605 is substituted with Threonine (T). In some embodiments, the amino acid at position 605 is substituted with Asparagine (N). In some embodiments, the Lysine (K) at position 605 is substituted with Threonine (T). In some embodiments, the Lysine (K) at position 367 is substituted with Asparagine (N). In some embodiments, the variant glucoamylase enzyme comprises or consists of the substitution K605T or K605N of SEQ ID NO:1. In some embodiments, the variant glucoamylase enzyme comprises or consists of the substitution K605T of SEQ ID NO:1. In some embodiments, the variant glucoamylase enzyme comprises or consists of the substitution K605N of SEQ ID NO:1.

In some embodiments, the variant glucoamylase enzyme comprises the G2P variants A114G/I190V/S204A/S285A/A350S/R371G/N599D.

In some embodiments, the variant enzyme of the invention comprise the amino acid substitutions A114G/I190V/S204A/S285A/A350S/R371G/N599D and are at least 95%, 96%, 97%, 98% or 99% identical to SEQ ID NO:65. In some embodiments the variant enzyme is SEQ ID NO:65.

In some embodiments, the variant enzyme of the invention comprise the amino acid substitutions E75D/A114G/Y118F/I190V/S204A/S285A/A350S/R371G/S507G/A530T/S563T/N599D and are at least 95%, 96%, 97%, 98% or 99% identical to SEQ ID NO:221. In some embodiments the variant enzyme is SEQ ID NO:221.

In some embodiments, the variant glucoamylase enzyme comprise the amino acid substitutions S24A/E75D/Q228P/L230F/C271W/P281S/A283G/L284F/S285V/S293F/T372P. In some embodiments, the parent glucoamylase enzyme is SEQ ID NO:1.

Specific embodiments of suitable amino acid substitutions sets are those found in FIG. 3, as compared to SEQ ID NO:1.

Additional specific embodiments of suitable amino acid substitution sets are those found in FIG. 4 made in the background of SEQ ID NO:1.

Further specific embodiments of suitable amino acid substitution sets are those found in FIG. 4, made in the background of G2P, SEQ ID NO:65.

The present invention also provides variant glucoamylase enzymes comprising an amino acid substitution at one or more (e.g., several) positions corresponding to positions 47, 599, 75, 221, 530, and/or 114 as compared to a parent glucoamylase enzyme. In some embodiments, the parent glucoamylase enzyme is SEQ ID NO:1.

The present invention also provides variant glucoamylase enzymes comprising an amino acid substitution at one or more (e.g., several) positions corresponding to positions 47, 599, 75, 221, 530, and/or 114, the variant glucoamylase enzyme has glucoamylase activity. In some embodiments, the variant has at least 75%, at least 80%, at least 85%, at least 90%, at least 95%, at least 96%, at least 97%, at least 98%, or at least 99%, but less than 100% sequence identity to the polypeptide of SEQ ID NO: 1.

In some embodiments, the variant glucoamylase enzyme comprises substitutions at one position selected from 114, 190, 221, 285, 350, 371, and 599 as compared to a parent glucoamylase enzyme. In some embodiments, the variant glucoamylase enzyme comprises substitutions at two positions, three positions, four positions, five positions, or all six positions selected from 114, 190, 221, 285, 350, 371, and 599 as compared to a parent glucoamylase enzyme. In some embodiments, the variant glucoamylase enzyme comprises at least one of the following substitutions as compared to a parent glucoamylase enzyme, wherein said substitutions are selected from the group consisting of: A134G, I210V, S224A, S305A, A370S, R391G, and N619D. In some embodiments, the parent glucoamylase enzyme is SEQ ID NO:1.

In some embodiments, the variant glucoamylase enzyme comprises substitutions at one position, two positions, three positions or all four positions selected from 47, 599, 75, and 221 as compared to a parent glucoamylase enzyme, and in particular, these substitutions are selected from the group consisting of: I47V, N599D, E75D, S221A, A530T, and A124G. In some embodiments, the parent glucoamylase enzyme is SEQ ID NO:1.

The amino acid changes that may be present in addition to the specific substitutions described herein may be of a minor nature, that is conservative amino acid substitutions or insertions that do not significantly affect the folding and/or activity of the protein; small deletions, typically of 1 to about 30 amino acids; small amino- or carboxyl-terminal extensions, such as an amino-terminal methionine residue; a small linker peptide of up to about 20 to about 25 residues; or a small extension that facilitates purification by changing net charge or another function, such as a poly-histidine tract, an antigenic epitope or a binding domain.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, LeuA al, Ala/Glu, and Asp/Gly.

A. Parent Glucoamylases

The parent glucoamylase enzyme may be (a) a polypeptide having at least 85% sequence identity to the polypeptide of SEQ ID NO:1; (b) a polypeptide encoded by a polynucleotide that hybridizes under medium-high stringency conditions with (i) the mature polypeptide coding sequence of SEQ ID NO: 2, or (ii) the full-length complement of (i); or (c) a polypeptide encoded by a polynucleotide having at least 70% sequence identity to the mature polypeptide coding sequence of SEQ ID NO: 2. For hybridization methods and conditions, see for example, Sambrook et al., 1989, Molecular Cloning, A Laboratory Manual, 2d edition, Cold Spring Harbor, N.Y.

In some embodiments, the parent glucoamylase enzyme has a sequence identity to the polypeptide of SEQ ID NO: 1 of at least 85%, at least 90%, at least 91%, at least 92%, at least 93%, at least 94%, at least 95%, at least 96%, at least 97%, at least 98%, at least 99%, or 100%, and have glucoamylase activity. In one aspect, the amino acid sequence of the parent differs by up to 10 amino acids, e.g., 1, 2, 3, 4, 5, 6, 7, 8, 9, or 10, from the mature polypeptide of SEQ ID NO: 1.

In some embodiments, the parent glucoamylase enzyme is encoded by a polynucleotide having a sequence identity to the mature polypeptide coding sequence of SEQ ID NO:2 of at least 70%, at least 75%, at least 80%, at least 85%, at least 90%, at least 91%, at least 92%, at least 93%, at least 94%, at least 95%, at least 96%, at least 97%, at least 98%, at least 99%, or 100%.

In some embodiments, the parent glucoamylase enzyme is an *Aspergillus clavatus* glucoamylase, e.g., the glucoamylase of SEQ ID NO:1.

In one embodiment, the variant glucoamylase enzymes are more stable than the parent variant glucoamylase enzyme when exposed to temperatures of 40° C., 45° C., 50° C., 52° C., 55° C., 56° C., 58° C., 60° C., 65° C., 66° C., 70° C., 75° C., 80° C. and/or 85° C. for a period of time, generally ranging from about 1, 2, 3, 4, 5, 6, 7, 8, 9 or 10 minutes or longer, depending on the ultimate conditions for the use of the variant glucoamylase enzyme, with some embodiments utilizing thermal challenge times of 5 minutes to 10 minutes, 5 minutes to 15 minutes, 5 minutes to 60 minutes, 10 minutes to 60 minutes all finding use in the present invention. In some embodiments, a challenge of 85° C. and 5 minutes is used.

Accordingly, in some embodiments the variant glucoamylase enzymes have increased thermostability as compared to a parent variant glucoamylase enzyme, particularly G1P, for at least 5 minutes at 50° C., at least 5-10 minutes at 52° C., at least 5-10 minutes at 55° C., at least 5-10 minutes at 58° C., at least 5-10 minutes at 56° C., at least 5-10 minutes at 60° C., at least 5-10 minutes at 66° C. and in some embodiments at least 5-10 minutes at 70° C.

In addition, pH can be a consideration for thermostability as well. Accordingly, in some embodiments the variant glucoamylase enzymes have increased thermostability as compared to a parent glucoamylase enzyme for at least 5 minutes at 52° C. at pH 4.5, or at least 5 minutes at 56° C. at pH 4.5. Accordingly, in some embodiments the variant glucoamylase enzymes have increased thermostability as compared to a parent glucoamylase enzyme for at least 10 minutes at 52° C. at pH 4.5, or at least 10 minutes at 56° C. at pH 4.5.

Accordingly, as shown in FIGS. 3A-E and 4A-B, a number of variant glucoamylase enzymes of the invention exhibit increased thermostability.

B. Nucleic Acid Compositions

The present invention also provides compositions comprising a variant glucoamylase enzyme encoding nucleic acid of the present invention. Such variant glucoamylase polypeptide encoding nucleic acids can encode any of the variant glucoamylase enzymes recited in the present application, including under section "C. Variant Glucoamylases" above. In some embodiments, the composition comprise a nucleic acid selected from the group consisting of SEQ ID NOs: 66, 222, 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 224, 226, 228, 230, 232, 234, 236, 238, 240, 242, 244, 246, 248, 250, 252, 254, 256, 258, 260, 262, 264, 266, 268, 270, 272, 274, 276, and 278.

In some embodiments, the composition comprises a nucleic acid of SEQ ID NO:66. In some embodiments, the composition comprises a nucleic acid of SEQ ID NO:222.

In some embodiments, the variant glucoamylase enzyme encoding nucleic acid comprises a codon optimized version or variant of any of SEQ ID NOs: 66, 222, 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 224, 226, 228, 230, 232, 234, 236, 238, 240, 242, 244, 246, 248, 250, 252, 254, 256, 258, 260, 262, 264, 266, 268, 270, 272, 274, 276, and 278. "Codon optimized" in this context is done in relation to a particular host organism and its generally preferred amino acid codons; that is, the host production organism, e.g. an *Aspergillus* species, may yield higher translation and/or secretion using *Aspergillus* preferred codons as compared to a yeast production organism.

In some embodiments, the compositions are enriched in such a variant glucoamylase enzyme encoding nucleic acid of the present invention. The term "enriched" indicates that the glucoamylase activity capable of being obtained from the composition has been increased, e.g., with an enrichment factor of at least 1. In some embodiments, the compositions are formulated to provide desirable characteristics such as low color, low odor and acceptable storage stability.

1. Preparation of Variants

The variants can be prepared generally by construction genes encoding the protein sequence using well known techniques, including site-directed mutagenesis of a parental gene and synthetic gene construction.

i. Regulatory Sequences

The present invention also relates to nucleic acid constructs comprising a polynucleotide encoding a variant of the present invention operably linked to one or more control sequences that direct the expression of the coding sequence in a suitable host cell under conditions compatible with the control sequences. The control sequence may include a promoter, a polynucleotide which is recognized by a host cell for expression of the polynucleotide. The promoter contains transcriptional control sequences that mediate the expression of the variant. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a filamentous fungal host cell are promoters obtained from *Aspergillus* species genes, as is known in the art, including *A. nidulans, A. niger* and *A. oryzae*, as well as *Rhizomucor* species genes such as *R. miehei*, *Trichoderma* species genes including *T. reesei*, *Fusarium* species genes including *F. venenatum*. Yeast control sequences including promoters are also well known from *Saccharomyces cerevisiae*.

Suitable promoter sequences (as well as other control sequences) from these species include the promoters from amylases (α-amylase in particular), glucoamylases, proteases, phosphatases, endoglucanases, cellulases, etc. as are known in the art. In addition, as for codon-optimization, it may be desirable to use promoters (and other control sequences) that are endogeneous to the host production strain, operably linked to the nucleic acids encoding the variant glucoamylases.

The control sequence may also be a transcription terminator, which is recognized by a host cell to terminate transcription. The terminator sequence is operably linked to the 3'-terminus of the polynucleotide encoding the variant. Any terminator that is functional in the host cell can be used.

In some embodiments, terminators (and other control sequences such as promoters) for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

In some embodiments, terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase.

The control sequence can also be an mRNA stabilizer region downstream of a promoter and upstream of the coding sequence of a gene which increases expression of the gene.

Examples of suitable mRNA stabilizer regions are obtained from a *Bacillus thuringiensis* crylllA gene (WO 94/25612) and a *Bacillus subtilis* SP82 gene (Hue et al., 1995, *Journal of Bacteriology* 177: 3465-3471).

The control sequence can also be a leader, a nontranslated region of an mRNA that is important for translation by the host cell. The leader sequence is operably linked to the 5'-terminus of the polynucleotide encoding the variant. Any leader that is functional in the host cell may be used.

In some embodiments, leaders for filamentous fungal host cells are obtained from the genes for *Aspergillus oryzae* TAKA amylase and *Aspergillus nidulans* triose phosphate isomerase.

In some embodiments, suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence can also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

In some embodiments, polyadenylation sequences for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

The control sequence may also be a signal peptide coding region that encodes a signal peptide linked to the N-terminus of a variant and directs the variant glucoamylase being expressed into the cell's secretory pathway. In many instances, the signal sequence is that depicted in FIG. 5, the endogeneous G1P signal sequence.

Effective signal peptide coding sequences for filamentous fungal host cells are the signal peptide coding sequences obtained from the genes for *Aspergillus niger* neutral amylase, *Aspergillus niger* glucoamylase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

Where both signal peptide and propeptide sequences are present, the propeptide sequence is positioned next to the N-terminus of the variant and the signal peptide sequence is positioned next to the N-terminus of the propeptide sequence.

It may also be desirable to add regulatory sequences that regulate expression of the variant relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the Gpd (Glyceraldehyde-3-phosphate dehydrogenase) from Ascomycota such as *Aspergillus*, *Aspergillus niger* glucoamylase promoter, *Aspergillus oryzae* TAKA alpha-amylase promoter, and *Aspergillus oryzae* glucoamylase promoter can be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the variant would be operably linked with the regulatory sequence.

2. Expression Vectors

The present invention also relates to recombinant expression vectors comprising a polynucleotide encoding a variant of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the variant at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector can be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used. Vectors contemplated for use with the methods of the invention include both integrating and non-integrating vectors.

In some embodiments, the vector contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

In some embodiments, the vector contains an element(s) that permits integration of the vector into the host cell's genome or autonomous replication of the vector in the cell independent of the genome.

For integration into the host cell genome, the vector can rely on the polynucleotide's sequence encoding the variant or any other element of the vector for integration into the genome by homologous or non-homologous recombination. Alternatively, the vector can contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector can further comprise an origin of replication enabling the vector to replicate autonomously in the host cell in question. The origin of replication can be any plasmid replicator mediating autonomous replication that functions in a cell. The term "origin of replication" or "plasmid replicator" means a polynucleotide that enables a plasmid or vector to replicate in vivo.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention can be inserted into a host cell to increase production of a variant, including the use of multiple genes encoding the variant glucoamylase in a vector, multiple vectors transformed into a cell, or multiple integrations of a vector into the genome. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

C. Particular Constructs

For expression in yeast, we used *Saccharomyces cerevisiae* INSCV1 strain (ThermoFisher Scientific, USA: Catalogue # V8251-20) and pYES2/CT vector (ThermoFisher Scientific, USA: Catalogue # V8251-20). Both are commercially available and are also discussed in Example 1 below.

1. Codon Optimization

Codon optimization can be employed with any of the variant glucoamylase enzymes of the present invention, in order to optimize expression in the host cell employed. Such methods are well known in the art and described in, for example, WO 2007/142954. In heterologous expression systems, optimization steps can improve the ability of the host to produce the desired variant glucoamylase enzymes. Protein expression is governed by a host of factors including those that affect transcription, mRNA processing, and stability and initiation of translation. The polynucleotide optimization steps can include steps to improve the ability of the host to produce the foreign protein as well as steps to assist the researcher in efficiently designing expression constructs. Optimization strategies can include, for example, the modification of translation initiation regions, alteration of mRNA structural elements, and the use of different codon biases.

In some embodiments, reduced heterologous protein expression occurs through interfering secondary structures. Secondary structures can sequester the RBS sequence or initiation codon and have been correlated to a reduction in protein expression. Stemloop structures can also be involved in transcriptional pausing and attenuation. An optimized polynucleotide sequence can contain minimal secondary structures in the RBS and gene coding regions of the nucleotide sequence to allow for improved transcription and translation.

In some embodiments, restriction sites can effect heterologous protein expression. By modifying restriction sites that could interfere with subsequent sub-cloning of transcription units into host expression vectors a polynucleotide sequence can be optimized.

In some embodiments, the optimized nucleic acid sequence can express the variant glucoamylase enzyme of the invention, at a level which is at least 110%, 150%, 200%, 500%, 1,000%, 5,000% or even 10,000% of that expressed by nucleic acid sequence that has not been optimized.

D. Host Cells and Production Strains

As will be appreciated by those in the art, there are a wide variety of production host organisms for the recombinant production of the variant glucoamylase enzymes of the invention, including, but not limited to bacterial cells and fungal cells including yeast.

The present invention also relates to recombinant host cells, comprising a polynucleotide encoding a variant glucoamlyase of the present invention operably linked to one or more control sequences that direct the production of a variant of the present invention. A construct or vector comprising a polynucleotide is introduced into a host cell so that the construct or vector is maintained as a chromosomal integrant or as a self-replicating extra-chromosomal vector as described earlier. The choice of a host cell will to a large extent depend upon the gene encoding the variant and the ability of the host production organism to yield high protein titers of expressed and/or secreted proteins. In some embodiments, the host cell exhibits transitory expression of the variant glucoamlyase. In some embodiments, the host cell is a stably transfected host or a host cell that stably (i.e., permanently) expresses the variant glucoamylase. In some embodiments, the host cell is a production host cell. The transformation and/or transfection of the host cells with the expression vectors comprising the coding region for the variant glucoamylases of the invention is done as is well known in the art (See Sambrook, id.).

The host cell can be any cell useful in the recombinant production of a variant, e.g., a prokaryote or a eukaryote. Such host cells include but are not limited to bacterial, fungal, and yeast cells. The host cell can also be a eukaryote, such as a mammalian, insect, plant, or fungal cell.

The host cell can be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, Ainsworth and Bisby's Dictionary of The Fungi, 8th edition, 1995, CAB International, University Press, Cambridge, UK). In many cases, host cells include *Aspergillus* species including *A. nidulans, A. niger* and *A. oryzae*, as well as *Rhizomucor* species such as *R. miehei, Trichoderma* species including *T. reesei* and *Fusarium* species genes including *F. venenatum*. The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes,* or *Trichoderma* cell. For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei,* or *Trichoderma viride* cell.

In some embodiments, the fungal host cell can be a yeast cell. "Yeast" as used herein includes ascosporogenous yeast (*Endomycetales*), basidiosporogenous yeast, and yeast belonging to the Fungi Imperfecti (*Blastomycetes*). The yeast host cell may be a *Candida, Hansenula, Kluyveromyces, Pichia, Saccharomyces, Schizosaccharomyces,* or *Yarrowia* cell such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis,* or *Yarrowia lipolytica* cell.

E. Protein Compositions

The present invention also provides compositions comprising a variant glucoamylase enzyme of the present invention. In some embodiments, the composition comprises a carrier and/or an excipient. In some embodiments, the compositions are enriched in such a variant glucoamylase enzyme of the present invention. The term "enriched" indicates that the glucoamylase activity of the composition has been increased, e.g., with an enrichment factor of at least 1.

In some embodiments, the compositions are formulated to provide desirable characteristics such as low color, low odor and acceptable storage stability.

In some embodiments, the composition comprises a variant glucoamylase enzyme of the present invention as the major enzymatic component, e.g., a mono-component composition.

In some embodiments, the composition may comprise one or more additional enzymes, depending on the end use, including, but not limited to, aminopeptidase, alpha-amylase, beta-amylase, isoamylase, carbohydrase, carboxypeptidase, catalase, cellulase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, invertase, laccase, lipase, mannosidase, oxidase, pectinolytic enzyme, peptidoglutaminase, peroxidase, glucoamylase, polyphenoloxidase, pullulanase, proteolytic enzyme, ribonuclease, transglutaminase, and/or xylanase.

In some embodiments, the composition comprises an alpha-amylase and the variant glucoamylase enzyme according to the invention. In some embodiments, the composition comprises an isoamylase and the variant glucoamylase enzyme according to the invention. In another embodiment the composition comprises an alpha-amylase, an isoamylase and the variant glucoamylase according to the invention.

In some embodiments, the composition comprises the variant glucoamylase enzyme of the invention combined with a pullulanase. In some embodiments, the composition comprises the variant glucoamylase of the invention combined with a pullulanas and an isoamylase. In some embodiments, the composition comprises the variant glucoamylase of the invention combined with a pullulanase and an alpha-amylase.

In some embodiments, the composition comprises the variant glucoamylase enzyme of the invention further comprises acid, neutral and/or alkaline proteases. In another embodiment the composition comprises the variant glucoamylase according to the invention and a cocktail of enzymes including alpha-amylase, proteases, peptidase, lipase, cellulose, pancreatin, and others.

F. Formulations of Variant Glucoamylases

In some embodiments, the compositions can be prepared in accordance with methods known in the art and can be in the form of a liquid or a dry composition. For instance, the composition may be in the form of granulate or microgranulate. The variant can be stabilized in accordance with methods known in the art.

In some embodiments, the enzyme composition (i.e., polypeptide compositions) of the present invention can be in any form suitable for use, such as, for example, a crude fermentation broth with or without cells removed, a cell lysate with or without cellular debris, a semi-purified or purified enzyme composition, or a host cell, as a source of the enzymes.

In some embodiments, the enzyme composition can be a dry powder or granulate, a non-dusting granulate, a liquid, a stabilized liquid, or a stabilized protected enzyme. Liquid enzyme compositions may, for instance, be stabilized by adding stabilizers such as a sugar, a sugar alcohol or another polyol, and/or lactic acid or another organic acid according to established processes.

In some embodiments, the dosage of the polypeptide composition of the invention and other conditions under which the composition is used may be determined on the basis of methods known in the art.

The above compositions are suitable for use in liquefaction, saccharification, and/or fermentation processes, and in some embodiments, in starch conversion. In some embodiments, the compositions are useful for producing a food product, including a syrup, as well as fermentation products, such as ethanol. In some embodiments, the compositions are useful for the pharmaceutical industry, such as in digestive aids.

In addition, as outlined below, the novel glucoamylases of the invention can be combined with other enzymes, including, but not limited to, alpha-amylases, pullulanases, cellulases (xylanases, ligninases, etc.) as more fully described below.

G. Methods of Production

The present invention also relates to methods of producing a variant glucoamylase enzyme, comprising: (a) cultivating a host cell of the present invention under conditions suitable for expression of the variant glucamylase polypeptide; and (b) optionally recovering the variant glucamylase polypeptide.

The host cells are cultivated in a nutrient medium suitable for production of the variant glucamylase polypeptide using methods known in the art. For example, the cell may be cultivated by shake flask cultivation, or small-scale or large-scale fermentation (including continuous, batch, fed-batch, or solid state fermentations) in laboratory or industrial fermentors performed in a suitable medium and under conditions allowing the variant to be expressed and/or isolated. The cultivation takes place in a suitable nutrient medium comprising carbon and nitrogen sources and inorganic salts, using procedures known in the art. Suitable media are available from commercial suppliers or can be prepared according to published compositions (e.g., in catalogues of the American Type Culture Collection). If the variant glucamylase polypeptide is secreted into the nutrient medium, the variant glucamylase polypeptide can be recovered directly from the medium. If the variant is not secreted, it can be recovered from cell lysates.

The variant glucamylase polypeptide can be detected using methods known in the art that are specific for the variants. These detection methods include, but are not limited to, use of specific antibodies, formation of an enzyme product, or disappearance of an enzyme substrate. For example, an enzyme assay may be used to determine the activity of the variant glucamylase polypeptide.

The variant glucamylase polypeptide can be recovered using methods known in the art. For example, the variant glucamylase polypeptide can be recovered from the nutrient medium by conventional procedures including, but not limited to, collection, centrifugation, filtration, extraction, spray-drying, evaporation, or precipitation.

The variant can be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., Protein Purification, Janson and Ryden, editors, VCH Publishers, New York, 1989) to obtain substantially pure variants.

In an alternative aspect, the variant is not recovered, but rather a host cell of the present invention expressing the variant is used as a source of the variant.

H. Methods of Using Variant Glucoamylases

Glucoamylase is regularly used in food and fermentation industries for the saccharification of starch to glucose.

The saccharification process can use glucoamlyase alone. Alternatively the saccharification process can be a synergetic action of a number of enzymes including glucoamylase in combination with amylase (particular α-amylase), and additional debranching enzymes such as pullulanases or isoamylases. Glucose isomerase can be further employed to convert glucose to fructose which is traditionally preferred due to its higher sweetness and easier metabolizability. For example, glucoamylase can be used in doughs to improve bread crust color and produce low-calorie beer. Another key application of glucoamylase is as a digestive aid when used together with a cocktail of other enzymes.

In some embodiments, the glucoamylase are used in animal feed stocks or in the production of animal feed stocks, including the components and use described in detail below.

As discussed herein, the use of glucoamylase enzyme in animal feeds has a number of benefits, including a feed cost savings, such as reductions in dietary inorganic phosphate, energy and amino acids, including a fast and efficient breakdown of dietary glucose and increased nutrient availability from glucose, as well as production benefits such as body weight gain for the non-ruminant subjects. In some embodiments, the variant glucoamylase enzymes of the invention are formulated and added to feed or can be made as a component of the feed. In the former case, the feed stock addition of glucoamylase enzyme can be done by formulating the variant glucoamylase enzyme on a carrier feed such as wheat flour. In some embodiments, the animal feed stocks or supplements are feed to livestock, including but not limited to cattle, pigs, sheep, bird, cat, fish, dog, equine, pet, poultry, etc. In some embodiments, the variant glucoamylase enzymes of the invention can be fed to humans (See, for example, "The Health Benefits of Glucoamylase," by Dr. Edward Group, Published Jun. 2, 2011 on Global Healing Center website,) as well as other commercially available products for human consumption such as VeganZyme®.

In some embodiments, the dosage of the polypeptide composition of the invention and other conditions under which the composition is used may be determined on the basis of methods known in the art.

The above compositions are suitable for use in liquefaction, saccharification, and/or fermentation processes, and in some embodiments, in starch conversion. In some embodiments, the compositions are useful for producing a food product, including a syrup, as well as fermentation products, such as ethanol. In some embodiments, the compositions are useful for the pharmaceutical industry, such as digestive aids.

In one embodiment, the variant glucoamylase enzymes are added to animal feed stock and pelleted as is known in the art, such that the feed is formed with glucoamylase enzyme in it. In other embodiments, the variant glucoamylase enzyme can be sprayed or dosed in a liquid form into animal feed.

I. Methods of Using Variant Glucoamylases

1. Industrial Applications

The variant glucoamylases of the present invention possess valuable properties allowing for a variety of industrial applications. In some embodiments, the glucoamylases may be used in feed stock production, beer making, ethanol production, biofuel production, and starch conversion processes.

In general, the major commercial application of glucoamylase is to catalyze starch saccharification resulting in glucose which can be used in food and fermentation processes. In general, this is a two step process, with the first step utilizing a dry solid starch slurry (30-35%, with optionally milling) that is gelatinized with a thermal treatment at 60 to 90 C with liquefaction at 95-105 C (generally pH 6.5) with an α-amylase. The α-amylase is an endo-acting enzyme, resulting in short-chain dextrins. These dextrins are then saccharified by glucoamylase to release glucose, a step that is usually done at 60 C for 2-4 days. It is this last step that results in the need for a thermostable glucoamylase.

In some embodiments, the present invention provides a biofuel made by the use of a variant glucoamylase enzyme that produces glucose, that is then subjected to a fermentation step to result in ethanol production (usually using a yeast).

The variant glucoamylases may be used for starch processes, in particular starch conversion, especially liquefaction of starch (see, e.g., U.S. Pat. No. 3,912,590, EP 252730 and EP 063909, WO 99/19467, and WO 96/28567, which are all hereby incorporated by reference). Also contemplated are compositions for starch conversion purposes, which may in addition to the glucoamylase of the invention further comprise an alpha-amylase, a pullulanase and/or a protease.

Further, the glucoamylases of the invention are particularly useful in the production of sweeteners and ethanol (see, e.g., U.S. Pat. No. 5,231,017, which is hereby incorporated by reference), such as fuel, drinking and industrial ethanol, from starch or whole grains.

In some embodiments, the present invention relates to a use of the glucoamylase according to the invention for production of syrup and/or a fermentation product from a starch containing material. The starch material may in one embodiment be gelatinized. In another embodiment the starch material is ungelatinized.

2. Starch Processing

As discussed herein, the novel glucoamylase enzymes of the invention find particular use in starch processing. Native starch consists of microscopic granules, which are insoluble in water at room temperature. When aqueous starch slurry is heated, the granules swell and eventually burst, dispersing the starch molecules into the solution. At temperatures up to about 50° C. to 75° C. the swelling may be reversible. However, with higher temperatures an irreversible swelling called "gelatinization" begins. During this "gelatinization" process there is a dramatic increase in viscosity. Granular starch to be processed may be a highly refined starch quality, preferably at least 90%, at least 95%, at least 97% or at least 99.5% pure or it may be a more crude starch-containing materials comprising (e.g., milled) whole grains including non-starch fractions such as germ residues and fibers. The raw material, such as whole grains, may be reduced in particle size, e.g., by milling, in order to open up the structure and allowing for further processing. In dry milling whole kernels are milled and used. Wet milling gives a good separation of germ and meal (starch granules and protein) and is often applied at locations where the starch hydrolyzate is used in the production of, e.g., syrups or other feed supplements. Both dry and wet milling is well known in the art of starch processing and may be used in a process of the invention. Methods for reducing the particle size of the starch containing material are well known to those skilled in the art.

As the solids level is 30-40% in a typical industrial process, the starch has to be thinned or "liquefied" so that it can be suitably processed. This reduction in viscosity is primarily attained by enzymatic degradation in current commercial practice.

Liquefaction can be carried out in the presence of an alpha-amylase, and in some embodiments, the alpha-amylase is a bacterial alpha-amylase and/or acid fungal alpha-amylase. In an embodiment, a glucoamylase is also present during liquefaction. In some embodiments, viscosity reducing enzymes such as a xylanase and/or beta-glucanase is also present during liquefaction. In some embodiments, acid protease is also present. In some embodiments, acid protease is also present to reduce corn steeping time.

In some embodiments, the process of the invention further comprises, prior to the conversion of a starch-containing material to sugars/dextrins the steps of: (i) reducing the particle size of the starch-containing material; and (ii) forming a slurry comprising the starch-containing material and water.

3. Beer Making

The variant glucoamylase enzymes can also be used in a beer-making process and similar fermentations.

J. Distillation

Optionally, following fermentation, an alcohol (e.g., ethanol) can be extracted by, for example, distillation and optionally followed by one or more process steps.

1. Enzymes

The enzyme(s) and polypeptides described below are to be used in an "effective amount" in processes of the present invention or can be combined with the variant glucoamylase enzymes of the invention. In some embodiments, the variant glucoamylase enzymes can be combined with enzymes including but not limited to alpha-amylases, bacterial alpha-amylases, bacterial hybrid alpha-amylases, fungal alpha-amylases, fungal hybrid alpha-amylases, carbohydrate-source generating Enzymes (Saccharifying Enzymes), glucoamylases, beta-amylases, maltogenic amylases, glucoamylases, pullulanases, and proteases.

a. Alpha-Amylases

Any alpha-amylase may be used, such as of fungal, bacterial or plant origin. In some embodiments, the alpha-amylase is an acid alpha-amylase, e.g., acid fungal or acid bacterial alpha-amylase. The term "acid alpha-amylase" means an alpha-amylase (EC 3.2.1.1) which added in an effective amount has activity optimum at a pH in the range of 3 to 7, from 3.5 to 6, or from 4-5.

b. Bacterial Alpha-Amylases

An alpha-amylase for use in the present invention may be a bacterial alpha-amylase, e.g., derived from *Bacillus*. In a preferred embodiment the *Bacillus* alpha-amylase is derived from a strain of *Bacillus amyloliquefaciens, Bacillus licheniformis, Bacillus stearothermophilus,* or *Bacillus subtilis,* but may also be derived from other *Bacillus* sp.

c. Bacterial Hybrid Alpha-Amylases

The alpha-amylase can be a hybrid alpha-amylase, e.g., an alpha-amylase comprising 445 C-terminal amino acid residues of the *Bacillus licheniformis* alpha-amylase and the 37 N-terminal amino acid residues of the alpha-amylase derived from *Bacillus amyloliquefaciens.* d. Fungal Alpha-Amylases

Fungal alpha-amylases include but are not limited to alpha-amylases derived from a strain of *Aspergillus*, such as, *Aspergillus kawachii, Aspergillus niger*, and *Aspergillus oryzae* alpha-amylases. In some embodiments, the alpha-amylase is derived from *Aspergillus kawachii* (Kaneko et al., 1996, *J. Ferment. Bioeng.* 81:292-298, "Molecular-cloning and determination of the nucleotide-sequence of a gene encoding an acid-stable alpha-amylase from *Aspergillus kawachii*; and further as EMBL: #AB008370)

The fungal alpha-amylase may also be a wild-type enzyme comprising a starch-binding domain (SBD) and an alpha-amylase catalytic domain, or a variant thereof.

2. Fungal Hybrid Alpha-Amylases

In some embodiments, the fungal acid alpha-amylase is a hybrid alpha-amylase. A hybrid alpha-amylase may comprise an alpha-amylase catalytic domain (CD) and a carbohydrate-binding domain/module (CBM), such as a starch binding domain (SBD), and optionally a linker.

3. Commercial Alpha-Amylase Products

In some embodiments, commercial compositions comprising alpha-amylase include MYCOLASE™ (DSM), BAN™, TERMAMYL™ SC, FUNGAMYL™, LIQUOZYME™ X, LIQUOZYME™ SC and SAN™ SUPER, SAN™ EXTRA L (Novozymes A/S) and CLARASE™ L-40,000, DEX-LO™, SPEZYME™ FRED, SPEZYME™ AA, SPEZYME™ ALPHA, SPEZYME™ DELTA AA, GC358, GC980, SPEZYME™ CL and SPEZYME™ RSL (DuPont Industrial Biosciences), and the acid fungal alpha-amylase from *Aspergillus niger* referred to as SP288 (available from Novozymes A/S, Denmark).

4. Carbohydrate-Source Generating Enzymes (Saccharifying Enzymes)

The term "carbohydrate-source generating enzyme" includes glucoamylase (a glucose generator), beta-amylase and maltogenic amylase (both maltose generators) and also alpha-glucosidase, isoamylase and pullulanase. A carbohydrate-source generating enzyme is capable of producing a carbohydrate that can be used as an energy-source by the fermenting organism(s) in question, for instance, when used in a process of the invention for producing a fermentation product, such as ethanol. The generated carbohydrate can be converted directly or indirectly to the desired fermentation product, preferably ethanol. A mixture of carbohydrate-source generating enzymes may be used. In some embodiments, blends include mixtures comprising at least a glucoamylase and an alpha-amylase, especially an acid amylase, even more preferred an acid fungal alpha-amylase.

In a conventional starch-to-ethanol process (i.e., including a liquefaction step), the ratio can be carried out as is known in the art, especially when saccharification and fermentation are carried out simultaneously.

5. Beta-Amylases

In some embodiments, a beta-amlyase can be included in the compositions of the invention. A beta-amylase (E.C 3.2.1.2) is the name traditionally given to exo-acting maltogenic amylases, which catalyze the hydrolysis of 1,4-alpha-glucosidic linkages in amylose, amylopectin and related glucose polymers.

Beta-amylases have been isolated from various plants and microorganisms (Fogarty and Kelly, 1979, Progress in Industrial Microbiology 15: 1 12-1 15). These beta-amylases are characterized by having a temperature optimum in the range from 40° C. to 65° C. and a pH optimum in the range from 4.5 to 7. A commercially available beta-amylase from barley is NOVOZYM™ WBA from Novozymes A/S, Denmark and SPEZYME™ BBA 1500 from DuPont Industrial Biosciences, USA.

6. Maltogenic Amylases

In some embodiments, a maltogenic amlyase can be included in the compositions of the invention and/or used in the processes of the invention. The amylase can be a maltogenic alpha-amylase (glucan 1,4-alpha-maltohydrolase, EC 3.2.1.133), which catalyzes the hydrolysis of amylose and amylopectin to maltose in the alpha-configuration. A maltogenic amylase from *Bacillus stearothermophilus* strain NCIB 1 1837 is commercially available from Novozymes A/S. Maltogenic.

The maltogenic amylase can be added in an amount of 0.05-5 mg total protein/gram DS or 0.05-5 MANU/g DS.

7. Phytases

In some embodiments, a glucoamylase can be included in the compositions of the invention. Any glucoamylase may be used in a process of the present invention. Phytases are enzymes that degrade phytates and/or phytic acid by specifically hydrolyzing the ester link between inositol and phosphorus. Phytase activity is credited with phosphorus and ion availability in many ingredients. In some embodiments, the glucoamylase is capable of liberating at least one inorganic phosphate from an inositol hexaphosphate (e.g., phytic acid). Phytases can be grouped according to their preference for a specific position of the phosphate ester group on the phytate molecule at which hydrolysis is initiated (e.g., 3-phytase (EC 3.1.3.8) or 6-phytases (EC 3.1.3.26)). An example of phytase is myo-inositol-hexakiphosphate-3-phosphohydrolase. Phytases can also include those in PCT application number PCT/US2016/040555, filed on Jun. 30, 2016, hereby incorporated by reference in its entirety, and in particular for the sequences of the phytases depicted therein.

In some embodiments, the glucoamylase is a commercially-available phytase, such commercially-available phytases include but are not limited to NATUPHOS (BASF), RONOZYME P (Novozymes A/S), PHYZYME (Danisco A/S, Verenium) and FINASE (AB Enzymes). The method for determining microbial phytase activity and the definition of a phytase unit is disclosed in Engelen et al., 1994, *Journal of AOAC International* 77: 760-764. In some embodiments, the phytase can be a wild-type phytase, an active variant or active fragment thereof.

8. Pullulanases

In some embodiments, a maltogenic amlyase can be included in the compositions of the invention and/or used in the processes of the invention. Pullulanases (E.C. 3.2.1.41, pullulan 6-glucano-hydrolase), are debranching enzymes characterized by their ability to hydrolyze the alpha-1,6-glycosidic bonds in, for example, amylopectin and pullulan.

In some embodiments, the pullulanase is a commercially-available pullulanase, such commercially-available pullulanases include but are not limited to PROMOZYME D, PROMOZYME™ D2 (Novozymes A/S, Denmark), OPTIMAX L-1000, OPTIMAX L-300 (DuPont Industrial Biosciences), and AMANO 8 (Amano, Japan).

9. Proteases

A protease can be added during saccharification, fermentation, simultaneous saccharification and fermentation. The protease may be any protease. In some embodiments, the protease is an acid protease of microbial origin, for example of fungal or bacterial origin. In some embodiments, the protease is an acid fungal protease, but also other proteases can be used.

Suitable proteases include but are not limited to microbial proteases, such as fungal and bacterial proteases.

In some embodiments, the proteases are acidic proteases, i.e., proteases characterized by the ability to hydrolyze proteins under acidic conditions below pH 7.

The protease can be a neutral or alkaline protease, such as a protease derived from a strain of *Bacillus*. In some embodiments, the particular protease is derived from *Bacillus amyloliquefaciens* and has the sequence obtainable at the Swissprot Database, Accession no. P06832.

In some embodiments, the protease is a protease preparation derived from a strain of *Aspergillus*, such as *Aspergillus oryzae*. In another embodiment the protease is derived from a strain of *Rhizomucor*, such as *Rhizomucor miehei*. In some embodiments the protease is a protease preparation, such as a mixture of a proteolytic preparation derived from a strain of *Aspergillus*, such as *Aspergillus oryzae*, and a protease derived from a strain of *Rhizomucor*, such as *Rhizomucor miehei*.

In some embodiments, the protease is a commercially-available protease, such commercially-available proteases include but are not limited to ALCALASE®, ESPERASE™, FLAVOURZYME™, NEUTRASE®, NOVOZYM™ FM 2.0L, and iZyme BA (available from Novozymes A/S, Denmark) and GC106™ and SPEZYME™ FAN from DuPont Industrial Biosciences, USA, and RENNI LASE® from DSM.

V. Examples

Example 1: G24 AcGlucoamylase Variant Preparation

Materials and Methods
Gene Synthesis and Cloning

The cDNA sequence of G24 AcGlucoamylase was obtained from UniProt with accession number EAW11709. The gene was synthesized by GenScript (see, the World Wide Web at genscript.com/). The synthesized gene was cloned into the pYES2/CT vector (Thermo Fisher Scientific, USA: Catalogue # V8251-20).

Mutant Design and Construction

To improve the activity and thermoactivity of G24 at pH4.5, 40° C., two and one mutant collections were designed based on protein sequence and structural analysis of G24 in G1 and G2 improvement, respectively. The design includes one to multiple specific mutations per mutant. The mutant collections were subsequently constructed using the QuickChange® Lightning kit (Agilent Technologies, Santa Clara, Calif.) and subsequently cloned into the pYES2/CT vector (ThermoFisher Scientific, USA: Catalogue # V8251-20).

Preparation of HTP Glucoamylase-Containing Wet Cell Pellets

The *Saccharomyces cerevisiae* INSCV1 strain (Thermo-Fisher Scientific, USA: Catalogue # V8251-20) containing recombinant glucoamylase-encoding genes from single colonies were inoculated into individual wells of 96 well plates containing 300 μl synthetic minimal defined medium (SC) with 2% glucose and no uracil supplementation. The cultures were grown overnight at 30° C., 250 rpm and 85% humidity. Appropriate volume of overnight culture from each well needed to obtain an $OD_{600}$ of 0.4 was added to corresponding wells of the new 96 well plates containing 350 μl of induction medium (SC selective medium containing 2% galactose). The plates were then incubated for 24 hrs. at 30° C., 250 rpm and 85% humidity. The cells were then pelleted using centrifugation at 4000 rpm for 10 min at 4° C. The supernatants were discarded and the pellets frozen at −80° C. prior to lysis.

Lysis of the HTP Glucoamylase Plates

150 μL of Y-PER yeast protein extraction reagent (ThermoFisher Scientific, USA: Catalogue #78990) was added to the cell paste in each well as described above. The cells were lysed at room temperature for 1.5 hours with shaking on a bench top shaker. The plate was then centrifuged for 10 min at 4000 rpm and 4° C. The clear supernatants were used to perform biochemical assays to determine activity.

Starch Assay to Determine Glucoamylase Activity

150 μl of 1% corn starch in 0.1M sodium acetate, pH 4.5 (final starch concentration of 0.75%) was added to 96 deep well plates. 15 μl-25 μl of enzyme from lysate plates described in example 4 was added to the starch reaction plates. The final volume was adjusted to 200 μl using 0.1M sodium acetate buffer, pH 4.5. The plates were incubated at 40° C., 800 rpm for 24-72 hrs. At 24, 25, 45 and/or 72 hrs, the plates were centrifuged at 4000 rpm for 5 minutes and 20 μl of reaction supernatant was taken out into 96 well shallow microtiter plates and 180 μl of D-Glucose assay reagent (GOPOD assay kit from Megazyme, Catalogue # K-GLUC) was added to each well. The plates were then incubated at 50° C. for 30 minutes. Following the incubation, the plates were read at 510 nm to monitor glucose released due to breakdown of starch. Activity of Glucoamylase variant was compared to the parent under the same conditions to determine activity improvement (FIGS. 3A-E and 4A-B).

Assay to Determine Thermostability

50 μl of the enzymes from the lysate plates was added to 96 well Biorad PCR plates and was challenged at either 52° C. (for G1) or 56° C. (for G2) in thermocyclers for 10 minutes. Following the 10 minutes incubation, 20 μl of the challenged lysate was added to 96 deep well starch reaction plates containing 150 μl of 2% corn starch in 0.1M sodium acetate, pH 4.5 (final starch concentration of 1.5%). The final volume was adjusted to 200 μl using 0.1M sodium acetate buffer, pH 4.5. The plates were incubated at 40° C., 800 rpm for 48 hrs. At 48 hrs, the plates were centrifuged at 4000 rpm for 5 minutes and 20 μl of reaction supernatant was taken out into 96 well shallow microtiter plates and 180 μl of D-Glucose assay reagent (GOPOD assay kit from Megazyme, Catalogue # K-GLUC) was added to each well. The plates were then incubated at 50° C. for 30 minutes. Following the incubation, the plates were read at 510 nm to monitor glucose released due to breakdown of starch. Activity of Glucoamylase variant was compared to the parent under the same conditions to determine thermos stability improvement (FIGS. 3A-E for G1 and FIGS. 4A-B for G2).

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only.

SEQUENCE LISTING (278 sequences)

SEQ ID NO: 1 - protein, 622 aa, Artificial Sequence
  Synthetic Glucoamylase (CL00002154 G24 AcGlucoamylase G1P)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 2 - DNA, 1866 bp, Artificial Sequence
  Synthetic Glucoamylase (CL00002154 G24 AcGlucoamylase G1P_
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 3 - protein, 622 aa, Artificial Sequence
  Synthetic Glucoamylase (CL00007376)
APNVSPRAGVGSLDSWLSAETTYALNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPPVFCYQQSFWTGSYMKANTGGGRSGKDANTVLASIHLFDPEAGWDDATFQPCSSRGFVNIKVFVDFFRGSLYPVNNGIPQGKAVAIGRYPEDVYYSGNPWFLTTLAVAEQLYDAIYQWKKSGAITITSTSLPFFQELYSAASTRPYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 4 - DNA, 1866 bp, Artificial Sequence
  Synthetic Glucoamylase (CL00007376)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggcccccccggttttttgctaccagcagagcttttggaccggctcctacatgaaggccaacactggcggtggccgctccggcaaggacgccaacaccgtcctggccagtatccacctgttcgaccccgaggctggctgggacgatgccaccttccagccctgctcttcccgcggttttgtcaacatcaaggtctttgtcgattttttccgcggcagtctttaccccgtcaacaacggtattccccagggcaaggccgttgccattggccgttaccccgaggatgtctattacagcggaaacccctggttcttgaccaccctggccgtcgccgagcagctgtatgacgccatctaccagtggaagaagagcggcgccatcaccatcaccagtacttcgctgccttttttccaggaactgtacagcgctgcttccacccgcccctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 5 - protein, 622 aa, Artificial Sequence
  Synthetic Glucoamylase (CL00007391)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSSATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 6 - DNA, 1866 bp, Artificial Sequence
  Synthetic Glucoamylase (CL00007391)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagctccgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 7 - protein, 622 aa, Artificial Sequence
  Synthetic Glucoamylase (CL00007399)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 8 - DNA, 1866 bp, Artificial Sequence
  Synthetic Glucoamylase (CL00007399)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 9 - protein, 622 aa, Artificial Sequence
  Synthetic Glucoamylase (CL00007410)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 10 - DNA, 1866 bp, Artificial Sequence
  Synthetic Glucoamylase (CL00007410)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 11 - protein, 622 aa, Artificial Sequence
  Synthetic Glucoamylase (CL00007417)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 12 - DNA, 1866 bp, Artificial Sequence
  Synthetic Glucoamylase (CL00007417)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 13 - protein, 622 aa, Artificial Sequence
  Synthetic Glucoamylase (CL00007422)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 14 - DNA, 1866 bp, Artificial Sequence
  Synthetic Glucoamylase (CL00007422)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 15 - protein, 622 aa, Artificial Sequence
  Synthetic Glucoamylase (CL00007424)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 16 - DNA, 1866 bp, Artificial Sequence
  Synthetic Glucoamylase (CL00007424)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 17 - protein, 622 aa, Artificial Sequence
  Synthetic Glucoamylase (CL00007426)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 18 - DNA, 1866 bp, Artificial Sequence
  Synthetic Glucoamylase (CL00007426)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 19 - protein, 622 aa, Artificial Sequence
  Synthetic Glucoamylase (CL00007453)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 20 - DNA, 1866 bp, Artificial Sequence
  Synthetic Glucoamylase (CL00007453)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 21 - protein, 622 aa, Artificial Sequence
  Synthetic Glucoamylase (CL00007454)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSYSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 22 - DNA, 1866 bp, Artificial Sequence
  Synthetic Glucoamylase (CL00007454)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcctactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 23 - protein, 1866 aa, Artificial Sequence
  Synthetic Glucoamylase (CL00007455)
GCCCCCAATGTCTCTCCTCGCGCCGGAGTTGGTTCTCTGGACTCTTGGTTGTCCGCTGAGACCACCTACTCTCTCAACAGCATTCTCACCAACACCGGATCCAACGGTGCCTATGCGAAGAGCGCGAAGCCTGGTATCATCATTGCCAGTCCCAGTCTGGAGGGTCCTAATTACTACTACACCTGGACTCGCGATGCCGCTCTGACCATGAGAGTGTTGATCGATGAGTTCCGCAACGGAAAAATCGAGCTTCAGAATGTGCTGAAGGACTATATAAACTCGCAGGCTTTCCTCCAGACCGTGGACAACCGCTCTGGTGGTCTCGCCAGCGGTGGTCTGGCCGAGCCCAAGTACAATGTGGACATGACCGCCTTCACTGGTGACTGGGGTCGTCCTCAGCGTGATGGCCCAGCTCTGCGTGCCACCGCCATGATTGACTTCGGCAACTGGCTGATTGACAATGGCTATGCCAGCTACGCCAAGGACAACATCTGGCCCATCGTCCGCAACGATCTGTCGTATGTGGCCCAGTACTGGCCCCAGAGCGGCTTTGACCTCTGGGAAGAAATCAACAGCATGTCCTTTTTCACGATCGCTGCCTCGCACCGTTCCCTCGTCGAGGGAAGCGCCTTTGCCAAGCGCGTTGGCGCCTCGTGCTCCTGGTGTGACTCCCAGGCCCCCCAGGTTCTCTGCTACCAGCAGAGCTTCTGGACCGGCTCCTACATGAAGGCCAACACTGGCGGTGGCCGCTCCGGCAAGGACGCCAACACCGTCCTGGCCAGTATCCACCTGTTCGACCCCGAGGCTGGCTGCGACGATGCCACCTTCCAGCCCTGCTCTCCCCGCGCTCTCTCCAACATCAAGGTCTTTGTCGATTCTTTCCGCGGCAGTCTCTACCCCGTCAACAACGGTATTCCCCAGGGCAAGGCCGTTGCCATTGGCCGTTACCCCGAGGATGTCTACTACAGCGGAAACCCCTGGTTCCTGACCACCCTGGCCGTCGCCGAGCAGCTGTATGACGCCATCTACCAGTGGAAGAAGAGCGGCGCCATCACCATCACCAGTACTTCGCTGCCTTTCTTCCAGGAACTGTACAGCGCTGCTTCCACCGGCACCTATGCCTCCTCGGACCCGGCCTTCAACGCGATCATCGACTCGGTCAAGACTTACGCCGACGGCTACGTCAGCATTGTGCAATCCCACTCCGCCAACAACGGCTCCCTCTCCGAGCAGTTCGACAAGACCTACGGCATGTCCACCTCCGCCCGCGACCTGACCTGGTCGTACGCCGCTCTCCTGACTGCCAACGCCCGCCGCGCCGGTGTCGTCCCCCCGTCCTGGGCCGCAGCCCAGAACAACCAGATCCCCGGCTCGTGCTCCAACAGCGGCGCCACCGGCACCTACCAGCCCGCCCCGATTAACAGCTGGCCCGTCCTGAGCAGCGGCACCCCCGGCACCCCCGGCACCACCACCACCGCCGCGACTGTTGGCACCTCCACCACCACCACCGCGCCCACCAGCACCACCACCGGCCCCGGCCAGTGCACCGTCCCCACCGCCGTGTCCGTGACCTTCGACGAGCTCGCGGCCACCGCCTACGGCGAGACCATTCTCATCGTCGGCTCCATCCCGGAGCTGGGCAGCTGGGACGCCACCAAGGCCGTCGCCCTCAGCGCCACCAAATACAGTGCCAGCAACCCCCTGTGGTTCGTGACCATCGACCTGCCCGCCGGCAAGAGCTTCGAGTACAAGTACATCCGCAAGCAGACCAACGGCAACGTCAAGTGGGAGAGCAACCCCAACCGCTCCTACAAGGTGCCTGCCACCTGCAACACCTTGACTGACGTCAAGAACGATACCTGGCGG

SEQ ID NO: 24 - DNA, 1866 bp, Artificial Sequence
  Synthetic Glucoamylase (CL00007455)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 25 - protein, 622 aa, Artificial Sequence
  Synthetic Glucoamylase (CL00007460)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 26 - DNA, 1866 bp, Artificial Sequence
  Synthetic Glucoamylase (CL00007460)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 27 - protein, 622 aa, Artificial Sequence
  Synthetic Glucoamylase (CL00007465)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 28 - DNA, 1866 bp, Artificial Sequence
  Synthetic Glucoamylase (CL00007465)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 29 - protein, 622 aa, Artificial Sequence
  Synthetic Glucoamylase (CL00007466)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 30 - DNA, 1866 bp, Artificial Sequence
  Synthetic Glucoamylase (CL00007466)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 31 - protein, 622 aa, Artificial Sequence
  Synthetic Glucoamylase (CL00007470)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWGAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 32 - DNA, 1866 bp, Artificial Sequence
  Synthetic Glucoamylase (CL00007470)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctggggcgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 33 - protein, 622 aa, Artificial Sequence
  Synthetic Glucoamylase (CL00007473)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 34 - DNA, 1866 bp, Artificial Sequence
  Synthetic Glucoamylase (CL00007473)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 35 - protein, 622 aa, Artificial Sequence
  Synthetic Glucoamylase (CL00007486)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 36 - DNA, 1866 bp, Artificial Sequence
  Synthetic Glucoamylase (CL00007486)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 37 - protein, 622 aa, Artificial Sequence
  Synthetic Glucoamylase (CL00007499)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 38 - DNA, 1866 bp, Artificial Sequence
  Synthetic Glucoamylase (CL00007499)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 39 - protein, 622 aa, Artificial Sequence
  Synthetic Glucoamylase (CL00007503)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 40 - DNA, 1866 bp, Artificial Sequence
  Synthetic Glucoamylase (CL00007503)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 41 - protein, 622 aa, Artificial Sequence
  Synthetic Glucoamylase (CL00007505)
APNVSPRAGVGSLDSWLSAETTYALNSILTNTGSNGAYAKSAKPGIVIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 42 - DNA, 1866 bp, Artificial Sequence
  Synthetic Glucoamylase (CL00007505)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 43 - protein, 622 aa, Artificial Sequence
  Synthetic Glucoamylase (CL00007507)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 44 - DNA, 1866 bp, Artificial Sequence
  Synthetic Glucoamylase (CL00007507)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 45 - protein, 622 aa, Artificial Sequence
  Synthetic Glucoamylase (CL00007512)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 46 - DNA, 1866 bp, Artificial Sequence
  Synthetic Glucoamylase (CL00007512)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgacaaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 47 - protein, 622 aa, Artificial Sequence
  Synthetic Glucoamylase (CL00007525)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 48 - DNA, 1866 bp, Artificial Sequence
  Synthetic Glucoamylase (CL00007525)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 49 - protein, 622 aa, Artificial Sequence
  Synthetic Glucoamylase (CL00007530)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 50 - DNA, 1866 bp, Artificial Sequence
  Synthetic Glucoamylase (CL00007530)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 51 - protein, 622 aa, Artificial Sequence
  Synthetic Glucoamylase (CL00007540)
APNVSPRAGVGSLDSWLSAETTYALNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 52 - DNA, 1866 bp, Artificial Sequence
  Synthetic Glucoamylase (CL00007540)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 53 - protein, 622 aa, Artificial Sequence
  Synthetic Glucoamylase (CL00007543)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 54 - DNA, 1866 bp, Artificial Sequence
  Synthetic Glucoamylase (CL00007543)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 55 - protein, 622 aa, Artificial Sequence
  Synthetic Glucoamylase (CL00007550)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVSNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 56 - DNA, 1866 bp, Artificial Sequence
  Synthetic Glucoamylase (CL00007550)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtgtccaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 57 - protein, 622 aa, Artificial Sequence
  Synthetic Glucoamylase (CL00007554)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 58 - DNA, 1866 bp, Artificial Sequence
  Synthetic Glucoamylase (CL00007554)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 59 - protein, 622 aa, Artificial Sequence
  Synthetic Glucoamylase (CL00007561)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 60 - DNA, 1866 bp, Artificial Sequence
  Synthetic Glucoamylase (CL00007561)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 61 - protein, 622 aa, Artificial Sequence
  Synthetic Glucoamylase (CL00007563)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 62 - DNA, 1866 bp, Artificial Sequence
  Synthetic Glucoamylase (CL00007563)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 63 - protein, 622 aa, Artificial Sequence
  Synthetic Glucoamylase (CL00007572)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 64 - DNA, 1866 bp, Artificial Sequence
  Synthetic Glucoamylase (CL00007572)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 65 - protein, 622 aa, Artificial Sequence
  Synthetic Glucoamylase (CL00007578 G24 AcGlucoamylase G2P)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 66 - DNA, 1866 bp, Artificial Sequence
  Synthetic Glucoamylase (CL00007578 G24 AcGlucoamylase G2P)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 67 - protein, 622 aa, Artificial Sequence
  Synthetic Glucoamylase (CL00007586)
APNVSPRAGVGSLDSWLSAETTYALNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 68 - DNA, 1866 bp, Artificial Sequence
  Synthetic Glucoamylase (CL00007586)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 69 - protein, 622 aa, Artificial Sequence
  Synthetic Glucoamylase (CL00007608)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 70 - DNA, 1866 bp, Artificial Sequence
  Synthetic Glucoamylase (CL00007608)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 71 - protein, 622 aa, Artificial Sequence
  Synthetic Glucoamylase (CL00007615)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWGAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 72 - DNA, 1866 bp, Artificial Sequence
  Synthetic Glucoamylase (CL00007615)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctggggcgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 73 - protein, 622 aa, Artificial Sequence
  Synthetic Glucoamylase (CL00007619)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 74 - DNA, 1866 bp, Artificial Sequence
  Synthetic Glucoamylase (CL00007619)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 75 - protein, 622 aa, Artificial Sequence
  Synthetic Glucoamylase (CL00007645)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 76 - DNA, 1866 bp, Artificial Sequence
  Synthetic Glucoamylase (CL00007645)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 77 - protein, 622 aa, Artificial Sequence
  Synthetic Glucoamylase (CL00007647)
APNVSPRAGVGSLDSWLSAETTYALNSILTNTGSNGAYAKSAKPGIVIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCNDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 78 - DNA, 1866 bp, Artificial Sequence
  Synthetic Glucoamylase (CL00007647)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcaacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 79 - protein, 622 aa, Artificial Sequence
  Synthetic Glucoamylase (CL00007650)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 80 - DNA, 1866 bp, Artificial Sequence
  Synthetic Glucoamylase (CL00007650)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 81 - protein, 622 aa, Artificial Sequence
  Synthetic Glucoamylase (CL00007660)
APNVSPRAGVGSLDSWLSAETTYALNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 82 - DNA, 1866 bp, Artificial Sequence
  Synthetic Glucoamylase (CL00007660)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 83 - protein, 622 aa, Artificial Sequence
  Synthetic Glucoamylase (CL00007669)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 84 - DNA, 1866 bp, Artificial Sequence
  Synthetic Glucoamylase (CL00007669)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 85 - protein, 622 aa, Artificial Sequence
  Synthetic Glucoamylase (CL00007671)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 86 - DNA, 1866 bp, Artificial Sequence
  Synthetic Glucoamylase (CL00007671)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 87 - protein, 622 aa, Artificial Sequence
  Synthetic Glucoamylase (CL00007683)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 88 - DNA, 1866 bp, Artificial Sequence
  Synthetic Glucoamylase (CL00007683)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 89 - protein, 624 aa, Artificial Sequence
  Synthetic Glucoamylase (CL00007692)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWRCL

SEQ ID NO: 90 - DNA, 1866 bp, Artificial Sequence
  Synthetic Glucoamylase (CL00007692)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 91 - protein, 622 aa, Artificial Sequence
  Synthetic Glucoamylase (CL00007693)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 92 - DNA, 1866 bp, Artificial Sequence
  Synthetic Glucoamylase (CL00007693)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 93 - protein, 622 aa, Artificial Sequence
  Synthetic Glucoamylase (CL00007722)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 94 - DNA, 1866 bp, Artificial Sequence
  Synthetic Glucoamylase (CL00007722)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 95 - protein, 622 aa, Artificial Sequence
  Synthetic Glucoamylase (CL00007732)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 96 - DNA, 1866 bp, Artificial Sequence
  Synthetic Glucoamylase (CL00007732)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 97 - protein, 622 aa, Artificial Sequence
  Synthetic Glucoamylase (CL00007743)
APNVSPRAGVGSLDSWLSAETTYALNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 98 - DNA, 1866 bp, Artificial Sequence
  Synthetic Glucoamylase (CL00007743)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 99 - protein, 622 aa, Artificial Sequence
  Synthetic Glucoamylase (CL00007744)
APNVSPRAGVGSLDSWLSAETTYALNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 100 - DNA, 1866 bp, Artificial Sequence
  Synthetic Glucoamylase (CL00007744)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 101 - protein, 622 aa, Artificial Sequence
  Synthetic Glucoamylase (CL00007745)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLGSIHLFDPEGGCDDATFQPCSPRALSNIKVFVDSFRGSLYPVNNGIPQGKAVAIGRYPEDVFYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 102 - DNA, 1866 bp, Artificial Sequence
  Synthetic Glucoamylase (CL00007745)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctgggcagtatccacctgttcgaccccgagggtggctgcgacgatgccaccttccagccctgctctccccgcgctctctccaacatcaaggtctttgtcgattcttttcgcggcagtctctaccccgtcaacaacggtattccccagggcaaggccgttgccattggccgttaccccgaggatgtattctacagcggaaacccctggttcttgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 103 - protein, 622 aa, Artificial Sequence
  Synthetic Glucoamylase (CL00007757)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 104 - DNA, 1866 bp, Artificial Sequence
  Synthetic Glucoamylase (CL00007757)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 105 - protein, 622 aa, Artificial Sequence
  Synthetic Glucoamylase (CL00007758)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQRYDAISQWKKSGAITITSTSLPFFQELYSDASTRTYASSDPAFNAIIDSVKTYADGYVSIVQSHSANNGSLSEQFDKTYGMSTSARDLTWSYAALLTANARRAGVVPPSWGAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 106 - DNA, 1866 bp, Artificial Sequence
  Synthetic Glucoamylase (CL00007758)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtgtactacagcggaaacccctggttcctgaccaccctggccgtcgccgagcagcggtatgacgccatctcccagtggaagaagagcggcgccatcaccatcaccagtacttcgctgcctttcttccaggaactgtacagcgatgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctggggcgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 107 - protein, 622 aa, Artificial Sequence
  Synthetic Glucoamylase (CL00007759)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 108 - DNA, 1866 bp, Artificial Sequence
  Synthetic Glucoamylase (CL00007759)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 109 - protein, 622 aa, Artificial Sequence
  Synthetic Glucoamylase (CL00007771)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 110 - DNA, 1866 bp, Artificial Sequence
  Synthetic Glucoamylase (CL00007771)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 111 - protein, 622 aa, Artificial Sequence
  Synthetic Glucoamylase (CL00007772)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 112 - DNA, 1866 bp, Artificial Sequence
  Synthetic Glucoamylase (CL00007772)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 113 - protein, 622 aa, Artificial Sequence
  Synthetic Glucoamylase (CL00007773)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 114 - DNA, 1866 bp, Artificial Sequence
  Synthetic Glucoamylase (CL00007773)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 115 - protein, 622 aa, Artificial Sequence
  Synthetic Glucoamylase (CL00007774)
APNVSPRAGVGSLDSWLSAETTYALNSILTNTGSNGAYAKSAKPGIVIASPSLEGPNYYYTWTRDAALTMRVLIEEFRNGKIELQNVLKDYINSQAFLQTVSNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 116 - DNA, 1866 bp, Artificial Sequence
  Synthetic Glucoamylase (CL00007774)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtgtccaaccgttctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 117 - protein, 622 aa, Artificial Sequence
  Synthetic Glucoamylase (CL00007776)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGATGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 118 - DNA, 1866 bp, Artificial Sequence
  Synthetic Glucoamylase (CL00007776)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcgccaccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 119 - protein, 622 aa, Artificial Sequence
  Synthetic Glucoamylase (CL00007781)
APNVSPRAGVGSLDSWLSAETTYALNSILTNTGSNGAYAKSAKPGIIIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 120 - DNA, 1866 bp, Artificial Sequence
  Synthetic Glucoamylase (CL00007781)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 121 - protein, 622 aa, Artificial Sequence
  Synthetic Glucoamylase (CL00007782)
APNVSPRAGVGSLDSWLSAETTYALNSILTNTGSNGAYAKSAKPGIVIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 122 - DNA, 1866 bp, Artificial Sequence
  Synthetic Glucoamylase (CL00007782)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 123 - protein, 622 aa, Artificial Sequence
  Synthetic Glucoamylase (CL00007793)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 124 - DNA, 1866 bp, Artificial Sequence
  Synthetic Glucoamylase (CL00007793)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 125 - protein, 622 aa, Artificial Sequence
  Synthetic Glucoamylase (CL00007799)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 126 - DNA, 1866 bp, Artificial Sequence
  Synthetic Glucoamylase (CL00007799)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 127 - protein, 622 aa, Artificial Sequence
  Synthetic Glucoamylase (CL00007802)
APNVSPRAGVGSLDSWLSAETTYALNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 128 - DNA, 1866 bp, Artificial Sequence
  Synthetic Glucoamylase (CL00007802)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 129 - protein, 622 aa, Artificial Sequence
  Synthetic Glucoamylase (CL00007806)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 130 - DNA, 1866 bp, Artificial Sequence
  Synthetic Glucoamylase (CL00007806)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 131 - protein, 622 aa, Artificial Sequence
  Synthetic Glucoamylase (CL00007810)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 132 - DNA, 1866 bp, Artificial Sequence
  Synthetic Glucoamylase (CL00007810)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 133 - protein, 622 aa, Artificial Sequence
  Synthetic Glucoamylase (CL00007813)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 134 - DNA, 1866 bp, Artificial Sequence
  Synthetic Glucoamylase (CL00007813)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 135 - protein, 622 aa, Artificial Sequence
  Synthetic Glucoamylase (CL00007821)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGSITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 136 - DNA, 1866 bp, Artificial Sequence
  Synthetic Glucoamylase (CL00007821)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 137 - protein, 622 aa, Artificial Sequence
  Synthetic Glucoamylase (CL00007827)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 138 - DNA, 1866 bp, Artificial Sequence
  Synthetic Glucoamylase (CL00007827)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 139 - protein, 622 aa, Artificial Sequence
  Synthetic Glucoamylase (CL00007829)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 140 - DNA, 1866 bp, Artificial Sequence; identical to SEQ ID NO: 138
  Synthetic Glucoamylase (CL00007827)

SEQ ID NO: 141 - protein, 622 aa, Artificial Sequence
  Synthetic Glucoamylase (CL00007837)
APNVSPRAGVGSLDSWLSAETTYALNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 142 - DNA, 1866 bp, Artificial Sequence
  Synthetic Glucoamylase (CL00007829)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 143 - protein, 622 aa, Artificial Sequence
  Synthetic Glucoamylase (CL00007860)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 144 - DNA, 1866 bp, Artificial Sequence
  Synthetic Glucoamylase (CL00007837)
gcccccaatgtctctcctcgcgccggagttggttctctggactcttggttgtccgctgagaccacctacgccctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 145 - protein, 622 aa, Artificial Sequence
  Synthetic Glucoamylase (CL00007982)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAAQHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 146 - DNA, 1866 bp, Artificial Sequence
  Synthetic Glucoamylase (CL00007860)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 147 - protein, 622 aa, Artificial Sequence
  Synthetic Glucoamylase (CL00007993)
APNVSPRAGVGSLDSWLSAETTYSLNSILTNIGSNGAYAKSAKPGIIIASPSLEGPNYYYTWTRDAALTMRVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYKVPATCNTLTDVKNDTWR

SEQ ID NO: 148 - DNA, 1866 bp, Artificial Sequence
  Synthetic Glucoamylase (CL00007982)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcccagcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 149 - protein, 622 aa, Artificial Sequence
  Synthetic Glucoamylase (CL00007996)
APNVSPRAGVGSLDSWLSAETTYSLNSILTNTGSNGAYAKSAKPGIIIASPSLEGPNYYYTWTRDAALTMRVLIEEFRNGKIELQNVIKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSSASTRTYASSDPAFNAIIDAVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYKVPATCNTLTDVKNDTWR

SEQ ID NO: 150 - DNA, 1866 bp, Artificial Sequence
  Synthetic Glucoamylase (CL00007996)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgatcaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagctccgcttccacccgcacctatgcctcctcggacccggccttcaacgcgatcatcgacgccgtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 151 - protein, 622 aa, Artificial Sequence
  Synthetic Glucoamylase (CL00007997)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 152 - DNA, 1866 bp, Artificial Sequence
  Synthetic Glucoamylase (CL00007997)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 153 - protein, 622 aa, Artificial Sequence
  Synthetic Glucoamylase (CL00008004)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYKVPATCNTLTDVKNDTWR

SEQ ID NO: 154 - DNA, 1866 bp, Artificial Sequence
  Synthetic Glucoamylase (CL00008004)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 155 - protein, 622 aa, Artificial Sequence
  Synthetic Glucoamylase (CL00008010)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYKVPATCNTLTDVKNDTWR

SEQ ID NO: 156 - DNA, 1866 bp, Artificial Sequence
  Synthetic Glucoamylase (CL00008010)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 157 - protein, 622 aa, Artificial Sequence
  Synthetic Glucoamylase (CL00008024)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYTVPATCNTLTDVKNDTWR

SEQ ID NO: 158 - DNA, 1866 bp, Artificial Sequence
  Synthetic Glucoamylase (CL00008024)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 159 - protein, 622 aa, Artificial Sequence
  Synthetic Glucoamylase (CL00008057)
APNVSPRAGVGSLDSWLSAETTYSLNSILTNTGSNGAYAKSAKPGIIIASPSLEGPNYYYTWTRDAALTMRVLIEEFRNGKIELQNVIKDYINSQAFLQTVDNPSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 160 - DNA, 1866 bp, Artificial Sequence
  Synthetic Glucoamylase (CL00008057)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgatcaaggactatataaactcgcaggctttcctccagaccgtggacaacccctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 161 - protein, 622 aa, Artificial Sequence
  Synthetic Glucoamylase (CL00008077)
APNVSPRAGVGSLDSWLSAETTYSLNSILTNTGSNGAYAKSAKPGIIIASPSLEGPNYYYTWTRDAALTMKVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 162 - DNA, 1866 bp, Artificial Sequence
  Synthetic Glucoamylase (CL00008077)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 163 - protein, 622 aa, Artificial Sequence
  Synthetic Glucoamylase (CL00008094)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSSASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 164 - DNA, 1866 bp, Artificial Sequence
  Synthetic Glucoamylase (CL00008094)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagctccgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 165 - protein, 622 aa, Artificial Sequence
  Synthetic Glucoamylase (CL00008100)
APNVSPRAGVGSLDSWLSAETTYSLNSILTNIGSNGAYAKSAKPGIIIASPSLEGPNYYYTWTRDAALTMKVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYTVPATCNTLTDVKNDTWR

SEQ ID NO: 166 - DNA, 1866 bp, Artificial Sequence
  Synthetic Glucoamylase (CL00008100)
gcccccaatgtctctcctcgcgccggagttggttctctggactcttggttgtccgctgagaccacctactctctcaacagcattctcaccaacatcggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 167 - protein, 622 aa, Artificial Sequence
  Synthetic Glucoamylase (CL00008103)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 168 - DNA, 1866 bp, Artificial Sequence
  Synthetic Glucoamylase (CL00008103)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 169 - protein, 622 aa, Artificial Sequence
  Synthetic Glucoamylase (CL00008127)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYTVPATCNTLTDVKNDTWR

SEQ ID NO: 170 - DNA, 1866 bp, Artificial Sequence
  Synthetic Glucoamylase (CL00008127)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 171 - protein, 622 aa, Artificial Sequence
  Synthetic Glucoamylase (CL00008139)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 172 - DNA, 1866 bp, Artificial Sequence
  Synthetic Glucoamylase (CL00008139)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 173 - protein, 622 aa, Artificial Sequence
  Synthetic Glucoamylase (CL00008185)
APNVSPRAGVGSLDSWLSAETTYSLNSILTNTGSNGAYAKSAKPGIIIASPSLEGPNYYYTWTRDAALTMRVLIEEFRNGKIELQNVIKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 174 - DNA, 1866 bp, Artificial Sequence
  Synthetic Glucoamylase (CL00008185)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgatcaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 175 - protein, 622 aa, Artificial Sequence
  Synthetic Glucoamylase (CL00008210)
APNVSPRAGVGSLDSWLSAETTYSLNSILTNIGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 176 - DNA, 1866 bp, Artificial Sequence
  Synthetic Glucoamylase (CL00008210)
gcccccaatgtctctcctcgcgccggagttggttctctggactcttggttgtccgctgagaccacctactctctcaacagcattctcaccaacatcggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 177 - protein, 622 aa, Artificial Sequence
  Synthetic Glucoamylase (CL00008233)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDAVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 178 - DNA, 1866 bp, Artificial Sequence
  Synthetic Glucoamylase (CL00008233)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgacgccgtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgatcaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 179 - protein, 622 aa, Artificial Sequence
  Synthetic Glucoamylase (CL00008257)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 180 - DNA, 1866 bp, Artificial Sequence
  Synthetic Glucoamylase (CL00008257)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 181 - protein, 622 aa, Artificial Sequence
  Synthetic Glucoamylase (CL00008274)
APNVSPRAGVGSLDSWLSAETTYSLNSILTNIGSNGAYAKSAKPGIIIASPSLEGPNYYYTWTRDAALTMRVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYTVPATCNTLTDVKNDTWR

SEQ ID NO: 182 - DNA, 1866 bp, Artificial Sequence
  Synthetic Glucoamylase (CL00008274)
gcccccaatgtctctcctcgcgccggagttggttctctggactcttggttgtccgctgagaccacctactctctcaacagcattctcaccaacatcggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 183 - protein, 622 aa, Artificial Sequence
  Synthetic Glucoamylase (CL00008291)
APNVSPRAGVGSLDSWLSAETTYSLNSILTNIGSNGAYAKSAKPGIIIASPSLEGPNYYYTWTRDAALTMKVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 184 - DNA, 1866 bp, Artificial Sequence
  Synthetic Glucoamylase (CL00008291)
gcccccaatgtctctcctcgcgccggagttggttctctggactcttggttgtccgctgagaccacctactctctcaacagcattctcaccaacatcggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 185 - protein, 622 aa, Artificial Sequence
  Synthetic Glucoamylase (CL00008296)
APNVSPRAGVGSLDSWLSAETTYSLNSILTNIGSNGAYAKSAKPGIIIASPSLEGPNYYYTWTRDAALTMRVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYKVPATCNTLTDVKNDTWR

SEQ ID NO: 186 - DNA, 1866 bp, Artificial Sequence
  Synthetic Glucoamylase (CL00008296)
gcccccaatgtctctcctcgcgccggagttggttctctggactcttggttgtccgctgagaccacctactctctcaacagcattctcaccaacatcggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 187 - protein, 622 aa, Artificial Sequence
  Synthetic Glucoamylase (CL00008310)
APNVSPRAGVGSLDSWLSAETTYSLNSILTNTGSNGAYAKSAKPGIIIASPSLEGPNYYYTWTRDAALTMKVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYTVPATCNTLTDVKNDTWR

SEQ ID NO: 188 - DNA, 1866 bp, Artificial Sequence
  Synthetic Glucoamylase (CL00008310)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgatcaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaccgtgcctgccacctgcaacaccttgactgacgtcaagaacgatacctggcgg

SEQ ID NO: 189 - protein, 622 aa, Artificial Sequence
  Synthetic Glucoamylase (CL00008316)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLAEPKFNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 190 - DNA, 1866 bp, Artificial Sequence
  Synthetic Glucoamylase (CL00008316)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 191 - protein, 622 aa, Artificial Sequence
  Synthetic Glucoamylase (CL00008327)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNPSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDAVKTYADGYVSIVQSHSANNGSLSEQFDKTYGMSLSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESNPNRSYKVPATCNTLTDVKNDTWR

SEQ ID NO: 192 - DNA, 1866 bp, Artificial Sequence
  Synthetic Glucoamylase (CL00008327)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaacccctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgacgccgtcaagacttacgccgacggctacgtcagcattgtgcaatcccactccgccaacaacggctccctctccgagcagttcgacaagacctacggcatgtccctgtccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 193 - protein, 622 aa, Artificial Sequence
  Synthetic Glucoamylase (CL00008329)
APNVSPRAGVGSLDSWLSAETTYSLNSILTNIGSNGAYAKSAKPGIIIASPSLEGPNYYYTWTRDAALTMKVLIEEFRNGKIELQNVLKDYINSQAFLQTVDNRSGGLASGGLAEPKYNVDMTAFTGDWGRPQRDGPALRATAMIDFGNWLIDNGYASYAKDNIWPIVRNDLSYVAQYWPQSGFDLWEEINSMSFFTIAASHRSLVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGAITITSTSLPFFQELYSAASTRTYASSDPAFNAIIDAVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESNPNRSYKVPATCNTLTDVKNDTWR

SEQ ID NO: 194 - DNA, 1866 bp, Artificial Sequence
  Synthetic Glucoamylase (CL00008329)
gcccccaatgtctctcctcgcgccggagttggttctctggactcttggttgtccgctgagaccacctactctctcaacagcattctcaccaacatcggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctggccgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaaatcaacagcatgtcctttttcacgatcgctgcctcgcaccgttccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggcgccatcaccatcaccagtacttcgctgcctttcttccaggaactgtacagcgctgcttccacccgcacctatgcctcctcggacccggccttcaacgcgatcatcgacgccgtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcaaccccaaccgctcctacaaggtgcctgccacctgcaacaccttgactgacgtcaagaacgatacctggcgg

SEQ ID NO: 195 - protein, 622 aa, Artificial Sequence
  Synthetic Glucoamylase (CL00015902)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 196 - DNA, 1866 bp, Artificial Sequence
  Synthetic Glucoamylase (CL00015902)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 197 - protein, 622 aa, Artificial Sequence
  Synthetic Glucoamylase (CL00015933)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 198 - DNA, 1866 bp, Artificial Sequence
  Synthetic Glucoamylase (CL00015933)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 199 - protein, 622 aa, Artificial Sequence
  Synthetic Glucoamylase (CL00015959)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 200 - DNA, 1866 bp, Artificial Sequence
  Synthetic Glucoamylase (CL00015959)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 201 - protein, 622 aa, Artificial Sequence
  Synthetic Glucoamylase (CL00015962)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 202 - DNA, 1866 bp, Artificial Sequence
  Synthetic Glucoamylase (CL00015962)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 203 - protein, 622 aa, Artificial Sequence
  Synthetic Glucoamylase (CL00015964)
APNVSPRAGVGSLDSWLSAETTYSLNSILTNTGSNGAYAKSAKPGIVIASPSLEGPNYYYTWTRDAALTMKVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 204 - DNA, 1866 bp, Artificial Sequence
  Synthetic Glucoamylase (CL00015964)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 205 - protein, 622 aa, Artificial Sequence
  Synthetic Glucoamylase (CL00015987)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 206 - DNA, 1866 bp, Artificial Sequence
  Synthetic Glucoamylase (CL00015987)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 207 - protein, 622 aa, Artificial Sequence
  Synthetic Glucoamylase (CL00015993)
APNVSPRAGVGSLDSWLSAETTYSLNSILTNTGSNGAYAKSAKPGIVIASPSLEGPNYYYTWTRDAALTMKVLIEEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSSASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 208 - DNA, 1866 bp, Artificial Sequence
  Synthetic Glucoamylase (CL00015993)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagctccgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 209 - protein, 622 aa, Artificial Sequence
  Synthetic Glucoamylase (CL00015999)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 210 - DNA, 1866 bp, Artificial Sequence
  Synthetic Glucoamylase (CL00015999)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 211 - protein, 622 aa, Artificial Sequence
  Synthetic Glucoamylase (CL00016001)
APNVSPRAGVGSLDSWLSAETTYSLNSILTNTGSNGAYAKSAKPGIVIASPSLEGPNYYYTWTRDAALTMKVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 212 - DNA, 1866 bp, Artificial Sequence
  Synthetic Glucoamylase (CL00016001)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 213 - protein, 622 aa, Artificial Sequence
  Synthetic Glucoamylase (CL00016012)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 214 - DNA, 1866 bp, Artificial Sequence
  Synthetic Glucoamylase (CL00016012)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 215 - protein, 622 aa, Artificial Sequence
  Synthetic Glucoamylase (CL00016013)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 216 - DNA, 1866 bp, Artificial Sequence
  Synthetic Glucoamylase (CL00016013)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 217 - protein, 622 aa, Artificial Sequence
  Synthetic Glucoamylase (CL00016014)
APNVSPRAGVGSLDSWLSAETTYSLNSILTNTGSNGAYAKSAKPGIIIASPSLEGPNYYYTWTRDAALTMKVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSSASTGTYASSDPAFNAIIDSVKTYADGYVSIVQSHSANNGSLSEQFDKTYGMSTSARDLTWSYAALLTANARRAGVVPPSWGAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 218 - DNA, 1866 bp, Artificial Sequence
  Synthetic Glucoamylase (CL00016014)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagctccgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctggggcgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 219 - protein, 622 aa, Artificial Sequence
  Synthetic Glucoamylase (CL00016023)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWGAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYNVPATCNTLTDVKNDTWR

SEQ ID NO: 220 - DNA, 1866 bp, Artificial Sequence
  Synthetic Glucoamylase (CL00016023)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctggggcgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaacgtgcctgccacctgcaacaccttgactgacgtcaagaacgatacctggcgg

SEQ ID NO: 221 - protein, 622 aa, Artificial Sequence
  Synthetic Glucoamylase (CL00016037 G24 AcGlucoamylase G3P)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTGTTTGPGQCTVPTAVSVTFDELATTAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 222 - DNA, 1866 bp, Artificial Sequence
  Synthetic Glucoamylase (CL00016037 G24 AcGlucoamylase G3P)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccggcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 223 - protein, 622 aa, Artificial Sequence
  Synthetic Glucoamylase (CL00016045)
APNVSPRAGVGSLDSWLSAETTYSLNSILTNTGSNGAYAKSAKPGIIIASPSLEGPNYYYTWTRDAALTMKVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 224 - DNA, 1866 bp, Artificial Sequence
  Synthetic Glucoamylase (CL00016045)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 225 - protein, 622 aa, Artificial Sequence
  Synthetic Glucoamylase (CL00016046)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 226 - DNA, 1866 bp, Artificial Sequence
  Synthetic Glucoamylase (CL00016046)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 227 - protein, 622 aa, Artificial Sequence
  Synthetic Glucoamylase (CL00016065)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 228 - DNA, 1866 bp, Artificial Sequence
  Synthetic Glucoamylase (CL00016065)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 229 - protein, 622 aa, Artificial Sequence
  Synthetic Glucoamylase (CL00016070)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 230 - DNA, 1866 bp, Artificial Sequence
  Synthetic Glucoamylase (CL00016070)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 231 - protein, 622 aa, Artificial Sequence
  Synthetic Glucoamylase (CL00016072)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 232 - DNA, 1866 bp, Artificial Sequence
  Synthetic Glucoamylase (CL00016072)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 233 - protein, 622 aa, Artificial Sequence
  Synthetic Glucoamylase (CL00016083)
APNVSPRAGVGSLDSWLSAETTYSLNSILTNTGSNGAYAKSAKPGIIIASPSLEGPNYYYTWTRDAALTMRVLIDEFRNGKIELQNVIKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 234 - DNA, 1866 bp, Artificial Sequence
  Synthetic Glucoamylase (CL00016083)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgatcaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 235 - protein, 622 aa, Artificial Sequence
  Synthetic Glucoamylase (CL00016087)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 236 - DNA, 1866 bp, Artificial Sequence
  Synthetic Glucoamylase (CL00016087)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 237 - protein, 622 aa, Artificial Sequence
  Synthetic Glucoamylase (CL00016109)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 238 - DNA, 1866 bp, Artificial Sequence
  Synthetic Glucoamylase (CL00016109)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 239 - protein, 622 aa, Artificial Sequence
  Synthetic Glucoamylase (CL00016119)
APNVSPRAGVGSLDSWLSAETTYSLNSILTNTGSNGAYAKSAKPGIIIASPSLEGPNYYYTWTRDAALTMRVLIDEFRNGKIELQNVIKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 240 - DNA, 1866 bp, Artificial Sequence
  Synthetic Glucoamylase (CL00016119)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgatcaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 241 - protein, 622 aa, Artificial Sequence
  Synthetic Glucoamylase (CL00016121)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 242 - DNA, 1866 bp, Artificial Sequence
  Synthetic Glucoamylase (CL00016121)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 243 - protein, 622 aa, Artificial Sequence
  Synthetic Glucoamylase (CL00016130)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 244 - DNA, 1866 bp, Artificial Sequence
  Synthetic Glucoamylase (CL00016130)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 245 - protein, 622 aa, Artificial Sequence
  Synthetic Glucoamylase (CL00016133)
APNVSPRAGVGSLDSWLSAETTYSLNSILTNTGSNGAYAKSAKPGIVIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 246 - DNA, 1866 bp, Artificial Sequence
  Synthetic Glucoamylase (CL00016133)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 247 - protein, 622 aa, Artificial Sequence
  Synthetic Glucoamylase (CL00016147)
APNVSPRAGVGSLDSWLSAETTYSLNSILTNTGSNGAYAKSAKPGIIIASPSLEGPNYYYTWTRDAALTMKVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSSASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 248 - DNA, 1866 bp, Artificial Sequence
  Synthetic Glucoamylase (CL00016147)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagctccgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 249 - protein, 622 aa, Artificial Sequence
  Synthetic Glucoamylase (CL00016154)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 250 - DNA, 1866 bp, Artificial Sequence
  Synthetic Glucoamylase (CL00016154)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 251 - protein, 622 aa, Artificial Sequence
  Synthetic Glucoamylase (CL00016157)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 252 - DNA, 1866 bp, Artificial Sequence
  Synthetic Glucoamylase (CL00016157)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 253 - protein, 622 aa, Artificial Sequence
  Synthetic Glucoamylase (CL00016180)
APNVSPRAGVGSLDSWLSAETTYSLNSILTNTGSNGAYAKSAKPGIVIASPSLEGPNYYYTWTRDAALTMKVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSSASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 254 - DNA, 1866 bp, Artificial Sequence
  Synthetic Glucoamylase (CL00016180)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaggtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagctccgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 255 - protein, 622 aa, Artificial Sequence
  Synthetic Glucoamylase (CL00016181)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAVGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 256 - DNA, 1866 bp, Artificial Sequence
  Synthetic Glucoamylase (CL00016181)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 257 - protein, 622 aa, Artificial Sequence
  Synthetic Glucoamylase (CL00016184)
APNVSPRAGVGSLDSWLSAETTYSLNSILTNTGSNGAYAKSAKPGIIIASPSLEGPNYYYTWTRDAALTMKVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 258 - DNA, 1866 bp, Artificial Sequence
  Synthetic Glucoamylase (CL00016184)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 259 - protein, 622 aa, Artificial Sequence
  Synthetic Glucoamylase (CL00016190)
APNVSPRAGVGSLDSWLSAETTYSLNSILTNTGSNGAYAKSAKPGIVIASPSLEGPNYYYTWTRDAALTMKVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 260 - DNA, 1866 bp, Artificial Sequence
  Synthetic Glucoamylase (CL00016190)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaggtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 261 - protein, 622 aa, Artificial Sequence
  Synthetic Glucoamylase (CL00016192)
APNVSPRAGVGSLDSWLSAETTYSLNSILTNTGSNGAYAKSAKPGIVIASPSLEGPNYYYTWTRDAALTMRVLIEEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 262 - DNA, 1866 bp, Artificial Sequence
  Synthetic Glucoamylase (CL00016192)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 263 - protein, 622 aa, Artificial Sequence
  Synthetic Glucoamylase (CL00016200)
APNVSPRAGVGSLDSWLSAETTYSLNSILTNTGSNGAYAKSAKPGIVIASPSLEGPNYYYTWTRDAALTMKVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSSASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 264 - DNA, 1866 bp, Artificial Sequence
  Synthetic Glucoamylase (CL00016200)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaggtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagctccgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 265 - protein, 622 aa, Artificial Sequence
  Synthetic Glucoamylase (CL00016204)
APNVSPRAGVGSLDSWLSAETTYSLNSILTNTGSNGAYAKSAKPGIVIASPSLEGPNYYYTWTRDAALTMKVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 266 - DNA, 1866 bp, Artificial Sequence
  Synthetic Glucoamylase (CL00016204)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgaaggtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggtcgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 267 - protein, 622 aa, Artificial Sequence
  Synthetic Glucoamylase (CL00016205)
APNVSPRAGVGSLDSWLSAETTYSLNSILTNTGSNGAYAKSAKPGIVIASPSLEGPNYYYTWTRDAALTMRVLIDEFRNGKIELQNVIKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAVGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWGAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 268 - DNA, 1866 bp, Artificial Sequence
  Synthetic Glucoamylase (CL00016205)
gcccccaatgtctctcctcgcgccggagttggttctctggactcttggttgtccgctgagaccacctactctctcaacagcattctcaccaacaccggatccaacggtgcctatgcgaagagcgcgaagcctggtatcgtcattgccagtcccagtctggagggtcctaattactactacacctggactcgcgatgccgctctgaccatgagagtgttgatcgatgagttccgcaacggaaaaatcgagcttcagaatgtgatcaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccgtcggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctggggcgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 269 - protein, 622 aa, Artificial Sequence
  Synthetic Glucoamylase (CL00016226)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDAVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 270 - DNA, 1866 bp, Artificial Sequence
  Synthetic Glucoamylase (CL00016226)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgacgccgtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 271 - protein, 622 aa, Artificial Sequence
  Synthetic Glucoamylase (CL00016233)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSISEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 272 - DNA, 1866 bp, Artificial Sequence
  Synthetic Glucoamylase (CL00016233)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccatctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 273 - protein, 622 aa, Artificial Sequence
  Synthetic Glucoamylase (CL00016238)
APNVSPRAGVGSLDSWLSAETTYSLNSILTNTGSNGAYAKSAKPGIIIASPSLEGPNYYYTWTRDAALTMRVLIDEFRNGKIELQNVLKDYINSQAFLQTVDNRSGGLASGGLGEPKFNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYSASNPLWFVTIDLPAGKSFEYKYIRKQTNGNVKWESDPNRSYKVPATCNTLTDVKNDTWR

SEQ ID NO: 274 - DNA, 1866 bp, Artificial Sequence
  Synthetic Glucoamylase (CL00016238)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagttcaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacagtgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 275 - protein, 622 aa, Artificial Sequence
  Synthetic Glucoamylase (CL00016265)
APNVSPRAGVGSLDSWLSAETTYSLNSILTNTGSNGAYAKSAKPGIIIASPSLEGPNYYYTWTRDAALTMKVLIDEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALSNIKVFVDSFRGSLYPVNNGIPQGKAVAIGRYPEDVYYSGNPWFLTTLAVAEQLYDAIYQWKKSGSITITSTSLPFFQELYSAASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELAATAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 276 - DNA, 1866 bp, Artificial Sequence
  Synthetic Glucoamylase (CL00016265)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgaaggtgttgatcgatgagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctctccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagcgctgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcggccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

SEQ ID NO: 277 - protein, 622 aa, Artificial Sequence
  Synthetic Glucoamylase (CL00016277)
APNVSPRAGVGSLDSWLSAETTYSLNSILTNTGSNGAYAKSAKPGIIIASPSLEGPNYYYTWTRDAALTMRVLIEEFRNGKIELQNVLKDYINSQAFLQTVDNRSGGLASGGLGEPKYNVDMTAFTGDWGRPQRDGPALRATAMIDFGNWLIDNGYASYAKDNIWPIVRNDLSYVAQYWPQSGFDLWEEVNSMSFFTIAASHRALVEGSAFAKRVGASCSWCDSQAPQVLCYQQSFWTGSYMKANTGGGRSGKDANTVLASIHLFDPEAGCDDATFQPCSPRALANIKVFVDSFRGSLYPVNNGIPQGKAVAIGRYPEDVYYSGNPWFLTTLAVAEQLYDAIYQWKKSGSITITSTSLPFFQELYSSASTGTYASSDPAFNAIIDSVKTYADGYVSIVQSHSANNGSLSEQFDKTYGMSTSARDLTWSYAALLTANARRAGVVPPSWAAAQNNQIPGSCSNSGATGTYQPAPINSWPVLSSGTPGTPGTTTTAATVGTSTTTTAPTSTTTGPGQCTVPTAVSVTFDELATTAYGETILIVGSIPELGSWDATKAVALSATKYTASNPLWFVTIDLPAGKSFEYKYIRKQTNGNVKWESDPNRSYKVPATCNTLTDVKNDTWR

SEQ ID NO: 278 - DNA, 1866 bp, Artificial Sequence
  Synthetic Glucoamylase (CL00016277)
gcccccaatgtctctcctcgcgccggagttggttctctggactcttggttgtccgctgagaccacctactctctcaacagcattctcaccaacaccggatccaacggtgcctatgcgaagagcgcgaagcctggtatcatcattgccagtcccagtctggagggtcctaattactactacacctggactcgcgatgccgctctgaccatgagagtgttgatcgaggagttccgcaacggaaaaatcgagcttcagaatgtgctgaaggactatataaactcgcaggctttcctccagaccgtggacaaccgctctggtggtctcgccagcggtggtctgggcgagcccaagtacaatgtggacatgaccgccttcactggtgactggggtcgtcctcagcgtgatggcccagctctgcgtgccaccgccatgattgacttcggcaactggctgattgacaatggctatgccagctacgccaaggacaacatctggcccatcgtccgcaacgatctgtcgtatgtggcccagtactggccccagagcggctttgacctctgggaagaagtcaacagcatgtcctttttcacgatcgctgcctcgcaccgtgccctcgtcgagggaagcgcctttgccaagcgcgttggcgcctcgtgctcctggtgtgactcccaggccccccaggttctctgctaccagcagagcttctggaccggctcctacatgaaggccaacactggcggtggccgctccggcaaggacgccaacaccgtcctggccagtatccacctgttcgaccccgaggctggctgcgacgatgccaccttccagccctgctctccccgcgctctcgccaacatcaaggtctttgtcgattctttccgcggcagtctctaccccgtcaacaacggtattccccagggcaaggccgttgccattggccgttaccccgaggatgtctactacagcggaaacccctggttcctgaccaccctggccgtcgccgagcagctgtatgacgccatctaccagtggaagaagagcggctccatcaccatcaccagtacttcgctgcctttcttccaggaactgtacagctccgcttccaccggcacctatgcctcctcggacccggccttcaacgcgatcatcgactcggtcaagacttacgccgacggctacgtcagcattgtgcaatcccactccgccaacaacggctccctctccgagcagttcgacaagacctacggcatgtccacctccgcccgcgacctgacctggtcgtacgccgctctcctgactgccaacgcccgccgcgccggtgtcgtccccccgtcctgggccgcagcccagaacaaccagatccccggctcgtgctccaacagcggcgccaccggcacctaccagcccgccccgattaacagctggcccgtcctgagcagcggcacccccggcacccccggcaccaccaccaccgccgcgactgttggcacctccaccaccaccaccgcgcccaccagcaccaccaccggccccggccagtgcaccgtccccaccgccgtgtccgtgaccttcgacgagctcgcgaccaccgcctacggcgagaccattctcatcgtcggctccatcccggagctgggcagctgggacgccaccaaggccgtcgccctcagcgccaccaaatacaccgccagcaaccccctgtggttcgtgaccatcgacctgcccgccggcaagagcttcgagtacaagtacatccgcaagcagaccaacggcaacgtcaagtgggagagcgatcccaaccgctcctacaaggtgcctgccacctgcaacaccttgactgacgtcaagaacgatacctggcgg

What is claimed:

1. A composition comprising a variant glucoamylase enzyme comprising an amino acid substitution as compared to SEQ ID NO:1, wherein said amino acid substitution is at a position selected from the group of: 114, 530, 190, 599, 24, 32, 47, 71, 75, 88, 102, 104, 118, 201, 204, 260, 228, 230, 269, 271, 272, 281, 283, 284, 285, 293, 350, 313, 321, 338, 343, 367, 371, 386, 372, 401, 408, 420, 448, 463, 483, 484, 507, 563 and 605, wherein said variant enzyme is at least 95% identical to SEQ ID NO:1, and wherein the variant enzyme retains glucoamylase activity.

2. A composition comprising a variant glucoamylase enzyme comprising an amino acid substitution as compared to SEQ ID NO:1, wherein said amino acid substitution is at a position selected from the group of: 114, 530, 190, 599, 24, 32, 47, 71, 75, 88, 102, 104, 118, 201, 204, 260, 228, 230, 269, 271, 272, 281, 283, 284, 285, 293, 350, 313, 321, 338, 343, 367, 371, 386, 372, 401, 408, 420, 448, 463, 483, 484, 507, 563 and 605, wherein said variant glucoamylase enzyme has at least 1.1 fold increased activity as compared to SEQ ID NO:1 under a condition selected from the group consisting of thermostability at 40° C., thermostability at 52° C., thermostability at 56° C. and thermostability at 60° C., and wherein said variant enzyme is at least 95% identical to SEQ ID NO:1.

3. The composition of claim 1, wherein said amino acid substitution is selected from the group consisting of: A114G, A530T, I190V, N599D, S24A, T32I, I47V, R71K, E75D, L88I, D102S, R104P, Y118F, S201Q, S204A, A260G, Q228P, L230F, A269G, C271W, D272N, P281S, A283G, L284F, S285V, S285A, S293F, A350S, I313V, Y321F, L338R, Y343S, A367D, A367S, R371G, S386A, T372P, H401Y, L408I, T420L, A448G, G463S, T483A, P484T, S507G, S563T, K605N, and K605T.

4. The composition of claim 1, wherein said variant glucoamylase enzyme exhibits at least 95%, 97%, 98%, or 99% identity to SEQ ID NO:1.

5. The composition of claim 1, wherein said variant glucoamylase enzyme has amino acid substitution(s) at one of said positions, two of said positions, three of said positions, four of said positions, five of said positions, six of said positions, seven of said positions, eight of said positions, nine of said positions, ten of said positions, eleven of said positions, twelve of said positions, thirteen of said positions, fourteen of said positions, fifteen of said positions, sixteen of said positions, seventeen of said positions, eighteen of said positions, nineteen of said positions or twenty of said positions.

6. The composition of claim 1, wherein said variant glucoamylase comprises the amino acid substitutions A114G/I190V/S204A/S285A/A350S/R371G/N599D.

7. The composition of claim 6, wherein said variant glucoamylase is at least 95% identical to SEQ ID NO: 65.

8. The composition of claim 6, wherein said variant glucoamylase is at least 99% identical to SEQ ID NO: 65.

9. The composition of claim 6, wherein said variant glucoamylase has SEQ ID NO: 65.

10. The composition of claim 6, wherein said variant glucoamylase further comprises an amino acid substitution selected from the group consisting of: A530T, S24A, T32I, I47V, R71K, E75D, L88I, D102S, R104P, Y118F, S201Q, A260G, Q228P, L230F, A269G, C271W, D272N, P281S, A283G, L284F, S285V, S293F, I313V, Y321F, L338R, Y343S, A367D, A367S, S386A, T372P, H401Y, L408I, T420L, A448G, G463S, T483A, P484T, S507G, S563T, K605N and K605T.

11. The composition of claim 1, wherein said variant glucoamylase comprises the amino acid substitutions: A114G/I190V/S204A/S285A/A350S/R371G/N599D/E75D/Y118F/S507G/A530T/S563T.

12. The composition of claim 11, wherein said variant glucoamylase is at least 95% identical to SEQ ID NO: 221.

13. The composition of claim 11, wherein said variant glucoamylase is at least 99% identical to SEQ ID NO: 221.

14. The composition of claim 11, wherein said variant glucoamylase has SEQ ID NO: 221.

15. The composition of claim 11, wherein said variant glucoamylase further comprises an amino acid substitution selected from the group consisting of: S24A, T32I, I47V, R71K, L88I, D102S, R104P, S201Q, A260G, Q228P, L230F, A269G, C271W, D272N, P281S, A283G, L284F, S285V, S293F, I313V, Y321F, L338R, Y343S, A367D, A367S, S386A, T372P, H401Y, L408I, T420L, A448G, G463S, T483A, P484T, K605N and K605T.

16. The composition of claim 1, wherein said variant glucoamylase enzyme has amino acid substitutions selected from the group consisting of: A114G/I190V/S204A/S285A/A350S/R371G/N599D, A114G/I190V/S204A/S285A/A350S/R371G/N599D/E75D/Y118F/S507G/A530T/S563T, S24A/E75D/Q228P/L230F/C271W/P281S/A283G/L284F/S285V/S293F/T372P, E75D/I190V/G463S, I47V/A114G/S285A/R371G, S24A/A114G, I47V/I190V/N599D, E75D, I47V/E75D/S204A, N599D, E75D/S285A, H401Y/N599D, E75D/R371G, I47V, I47V/I313V, S204A, A448G, I47V/A114G/A530T, E75D/S285A/A350S, I47V/A114G/S285A/I313V, S285A/R371G/N599D, S24A/I47V/E75D/S204A/S285A, I313V/A530T, I47V/E75D/S204A/A530T, I190V/A350S/R371G, I47V/R371G, S24A/I47V/I190V/S285A/A350S, I47V/N599D, D102S/A114G/N599D, S24A/A114G/N599D, A530T, I47V/I190V, I190V/S285A/A350S/N599D, S24A/I47V/S204A/S285A, I313V, I47V/I190V/S285A/A448G/N599D, I47V/I190V/S285A/I313V, S24A, S24A/I47V/E75D/D272N/N599D, A114G/A350S, S24A/I47V/A530T, I47V/E75D/A114G/I313V/N599D, I47V/A114G/S204A/N599D, S24A/I190V, E75D/I313V/N599D, I47V/I190V/S285A, A114G/S204A/A530T, I47V/

E75D, S24A/I47V/R371G/N599D, S24A/E75D/S285A, I47V/A114G/A260G/A269G/Y321F/A350S/N599D, S24A/A350S/R371G/A530T, A114G/L338R/Y343S/A367D/A448G, S24A/A114G/I190V/S204A, A350S, A350S/N599D, S204A/I313V/A350S/N599D, S24A/I47V/D102S/A114G/I190V/S285A/A350S, A350S/T483A/P484T, S24A/E75D/N599D, S24A/I47V/E75D/A114G/I190V/S285A, S285A/N599D, I47V/E75D/S285A/R371G/N599D, S24A/I47V/A114G/S285A, I47V/A114G, I47V/A350S/N599D, R371G/N599D, S24A/A114G/S204A/S285A/I313V/A350S, S285A, I47V/S204A, S24A/A114G/R371G, I47V/S204A/S285A/N599D, S201Q/K605T, T32I/Y118F/S563T, L88I/Y118F/A367S/S386A/T420L/S563T, T420L, Y118F/S563T, S563T, T420L/S563T/K605T, L88I/R104P/K605T, R71K, Y118F/A367S, T32I/R71K/Y118F/S563T/K605T, T420L/K605T, S563T/K605T, Y118F/K605T, L88I, T32I/K605T, S386A/T420L, K605T, T32I/Y118F/T420L/K605T, T32I/R71K, T32I/S563T, R71K/S563T/K605T, Y118F, R104P/S386A/T420L/S563T, T32I/R71K/S386A, A114G/I190V/S204A/S285A/A350S/R371G/N599D/E75D, A114G/I190V/S204A/S285A/A350S/R371G/N599D/E75D/Y118F/A285S/S563T, A114G/I190V/S204A/S285A/A350S/R371G/N599D/E75D/Y118F/A285S, A114G/I190V/S204A/S285A/A350S/R371G/N599D/E75D/A285S/A530T, A114G/I190V/S204A/S285A/A350S/R371G/N599D/I47V/R71K/I313V/A530T/S563T, A114G/I190V/S204A/S285A/A350S/R371G/N599D/Y118F/I313V, A114G/I190V/S204A/S285A/A350S/R371G/N599D/I47V/R71K/Y118F/A367S/S563T, A114G/I190V/S204A/S285A/A350S/R371G/N599D/E75D/I313 V, All 4G/I190 V/S204A/S28 5A/A3 5 0 S/R3 71G/N5 99D/I47 V/R71K, A114G/I190V/S204A/S285A/A350S/R371G/N599D/I47V/E75D/Y118F, A114G/I190V/S204A/S285A/A350S/R371G/N599D/Y118F/A285S, A114G/I190V/S204A/S285A/A3 50S/R371G/N599D/R71K/A367S/A448G, A114G/I190V/S204A/S285A/A350S/R371G/N599D/A448G/S563T/K605N, A114G/I190 V/S204A/S285A/A350S/R371G/N599D/R71K/E75D/S563T, A114G/I190V/S204A/S285 A/A350S/R371G/N599D/I47V/E75D/A530T, A114G/I190V/S204A/S285A/A350S/R371G/N599D/I47V/E75D/Y118F/A285S, A114G/I190V/S204A/S285A/A350S/R371G/N599D/E75D/Y118F, A114G/I190V/S204A/S285A/A3 50S/R371G/N599D/I47V/E75D, A114G/I190V/S204A/S285A/A350S/R371G/N599D/E75D/L88I, A114G/I190V/S204A/S285A/A350S/R371G/N599D/E75D/S563T, A114G/I190V/S204A/S285A/A350S/R371G/N599D/I47V, A114G/I190V/S204A/S285A/A350S/R371G/N599D/E75D/L88I/Y118F/A285S, A114G/I190V/S204A/S285A/A350S/R371G/N599D/Y118F, A114G/I190V/S204A/S285A/A350S/R371G/N599D/Y118F/S563T, A114G/I190V/S204A/S285A/A3 50S/R371G/N599D/I47V/E75D/A285 S, A114G/I190V/S204A/S285A/A350S/R371G/N599D/R71K/E75D/A367S/S563T, A114G/I190V/S204A/S285A/A350S/R371G/N599D/I47V/I313 V, A114G/I190V/S204A/S285A/A350S/R371G/N599D/I47V/S563T, A114G/I190V/S204A/S285A/A3 50S/R371G/N599D/I47V/R71K/E75D/A367S, A114G/I190V/S204A/S285A/A350S/R371G/N599D/I47V/I1313 V/A530T, A114G/I190V/S204A/S285A/A350S/R371G/N599D/R71K, A114G/I190V/S204A/S285A/A3 50S/R371G/N599D/I47V/R71K/E75D, A114G/I190V/S204A/S285A/A350S/R371G/N599D/I47V/Y118F, A114G/I190V/S204A/S285A/A3 50S/R371G/N599D/I47V/R71K/A285 S/A367S, A114G/I190V/S204A/S285A/A3 50S/R371G/N599D/I47V/R71K/E75D/A285 S, A114G/I190V/S204A/S285A/A3 50S/R371G/N599D/I47V/E75D/L88I/A285 S/I313 V/A448 G, A114G/I190V/S204A/S285A/A350S/R371G/N599D/E75D/S386A, A114G/I190V/S204A/S285A/A350S/R371G/N599D/E75D/L408I, A114G/I190V/S204A/S285A/A350S/R371G/N599D/E75D/Y118F/A530T, A114G/I190V/S204A/S285A/A350S/R371G/N599D/R71K/E75D/A285S/S563T, and A114G/I190V/S204A/S285A/A350S/R371G/N599D/A367S/A530T/S563T.

17. The composition of claim 1, wherein said variant glucoamylase enzyme comprises a sequence selected from the group consisting of SEQ ID NOs: 65, 221, 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 223, 225, 227, 229, 231, 233, 235, 237, 239, 241, 243, 245, 247, 249, 251, 253, 255, 257, 259, 261, 263, 265, 267, 269, 271, 273, 275, and 277.

18. An animal feed supplement comprising the composition of claim 1.

19. A formulation suitable for consumption by an animal, wherein said formulation comprises the composition of claim 1.

20. The composition of claim 1, wherein said glucoamylase activity is measured using a starch assay.

* * * * *